(12) United States Patent
Emig et al.

(10) Patent No.: US 8,999,676 B2
(45) Date of Patent: *Apr. 7, 2015

(54) RECOMBINANT POLYMERASES FOR IMPROVED SINGLE MOLECULE SEQUENCING

(75) Inventors: Robin Emig, Belmont, CA (US); Lei Jia, North Potomac, MD (US); Satwik Kamtekar, Redwood City, CA (US); Erik Miller, San Francisco, CA (US); Colleen Cutcliffe, Menlo Park, CA (US); Walter Lee, Campbell, CA (US)

(73) Assignee: Pacific Biosciences of California, Inc., Menlo Park, CA (US)

( * ) Notice: Subject to any disclaimer, the term of this patent is extended or adjusted under 35 U.S.C. 154(b) by 482 days.

This patent is subject to a terminal disclaimer.

(21) Appl. No.: 13/176,697

(22) Filed: Jul. 5, 2011

(65) Prior Publication Data

US 2012/0034602 A1    Feb. 9, 2012

Related U.S. Application Data

(63) Continuation-in-part of application No. 12/924,701, filed on Sep. 30, 2010, now Pat. No. 8,420,366, and a continuation-in-part of application No. 12/384,112, filed on Mar. 30, 2009, now Pat. No. 8,257,954.

(60) Provisional application No. 61/399,108, filed on Jul. 6, 2010, provisional application No. 61/278,041, filed on Sep. 30, 2009, provisional application No. 61/072,645, filed on Mar. 31, 2008, provisional application No. 61/094,843, filed on Sep. 5, 2008.

(51) Int. Cl.
  *C12N 15/54*   (2006.01)
  *C12N 9/00*    (2006.01)
  *C12N 9/12*    (2006.01)
  *C12Q 1/68*    (2006.01)

(52) U.S. Cl.
  CPC ............ *C12N 9/1252* (2013.01); *C12Q 1/6869* (2013.01)

(58) Field of Classification Search
  None
  See application file for complete search history.

(56) References Cited

U.S. PATENT DOCUMENTS

| | | | |
|---|---|---|---|
| 5,001,050 A | 3/1991 | Blanco et al. |
| 5,198,543 A | 3/1993 | Blanco et al. |
| 5,328,824 A | 7/1994 | Ward et al. |
| 5,409,811 A | 4/1995 | Tabor et al. |
| 5,476,928 A | 12/1995 | Ward et al. |
| 5,576,204 A | 11/1996 | Blanco et al. |
| 5,723,584 A | 3/1998 | Schatz |
| 5,874,239 A | 2/1999 | Schatz |
| 6,165,765 A | 12/2000 | Hong et al. |
| 6,399,320 B1 | 6/2002 | Markau et al. |
| 6,399,335 B1 | 6/2002 | Kao et al. |
| 6,447,724 B1 | 9/2002 | Jensen et al. |
| 6,610,486 B1 | 8/2003 | Dahlhauser |
| 6,762,048 B2 | 7/2004 | Williams et al. |
| 6,787,308 B2 | 9/2004 | Balassbramanian et al. |
| 6,917,726 B2 | 7/2005 | Levene et al. |
| 6,936,702 B2 | 8/2005 | Williams et al. |
| 7,033,764 B2 | 4/2006 | Korlach et al. |
| 7,041,812 B2 | 5/2006 | Kumar et al. |
| 7,052,847 B2 | 5/2006 | Korlach et al. |
| 7,056,661 B2 | 6/2006 | Korlach et al. |
| 7,056,676 B2 | 6/2006 | Korlach et al. |
| 7,057,026 B2 | 6/2006 | Barnes et al. |
| 7,315,019 B2 | 1/2008 | Turner et al. |
| 7,405,281 B2 | 7/2008 | Xu et al. |
| 2003/0044781 A1 | 3/2003 | Korlach et al. |
| 2003/0124576 A1 | 7/2003 | Kumar et al. |
| 2006/0051807 A1 | 3/2006 | Fuller |
| 2006/0063173 A1 | 3/2006 | Williams et al. |
| 2007/0036511 A1 | 2/2007 | Lunduist et al. |
| 2007/0077564 A1 | 4/2007 | Roitman et al. |
| 2007/0188750 A1 | 8/2007 | Lunduist et al. |
| 2007/0196846 A1 | 8/2007 | Hanzel et al. |
| 2007/0206187 A1 | 9/2007 | Lunduist et al. |

(Continued)

FOREIGN PATENT DOCUMENTS

WO    WO 02/086088 A2    10/2002
WO    WO 2007/075987 A2   7/2007

(Continued)

OTHER PUBLICATIONS

Ngo et al. in The Protein Folding Problem and Tertiary Structure Prediction, 1994, Merz et al. (ed.), Birkhauser, Boston, MA, pp. 433 and 492-495.*

(Continued)

*Primary Examiner* — Richard Hutson
(74) *Attorney, Agent, or Firm* — Quine Intellectual Property Law Group, P.C.; Monicia Elrod-Erickson; Robert Reamey

(57) ABSTRACT

Provided are compositions comprising recombinant DNA polymerases that include amino acid substitutions, insertions, deletions, and/or exogenous features that confer modified properties upon the polymerase for enhanced single molecule sequencing. Such properties can include enhanced metal ion coordination, reduced exonuclease activity, reduced reaction rates at one or more steps of the polymerase kinetic cycle, decreased branching fraction, altered cofactor selectivity, increased yield, increased thermostability, increased accuracy, increased speed, increased readlength, and the like. Also provided are nucleic acids which encode the polymerases with the aforementioned phenotypes, as well as methods of using such polymerases to make a DNA or to sequence a DNA template.

8 Claims, 122 Drawing Sheets

(56) References Cited

U.S. PATENT DOCUMENTS

| | | | |
|---|---|---|---|
| 2008/0030628 | A1 | 2/2008 | Lunduist et al. |
| 2008/0108082 | A1 | 5/2008 | Rank et al. |
| 2008/0199932 | A1* | 8/2008 | Hanzel et al. ............... 435/176 |
| 2008/0212960 | A1 | 9/2008 | Lundquist et al. |
| 2008/0299565 | A1 | 12/2008 | Schneider et al. |
| 2009/0029385 | A1 | 1/2009 | Christians et al. |
| 2009/0181396 | A1 | 7/2009 | Luong et al. |
| 2009/0208961 | A1 | 8/2009 | Bjornson et al. |
| 2009/0280538 | A1 | 11/2009 | Patel et al. |
| 2009/0298075 | A1 | 12/2009 | Travers et al. |
| 2010/0075332 | A1 | 3/2010 | Patel et al. |
| 2010/0093555 | A1 | 4/2010 | Bjornson et al. |
| 2010/0112645 | A1 | 5/2010 | Clark et al. |
| 2010/0261185 | A1 | 10/2010 | Nikiforov |
| 2011/0014612 | A1 | 1/2011 | Hendricks et al. |
| 2011/0165652 | A1 | 7/2011 | Hardin et al. |
| 2011/0189659 | A1 | 8/2011 | Clark et al. |

FOREIGN PATENT DOCUMENTS

| | | |
|---|---|---|
| WO | WO 2007/076057 A2 | 7/2007 |
| WO | WO 2007/123763 A2 | 11/2007 |
| WO | WO 2007/137060 A2 | 11/2007 |
| WO | WO 2008/051530 A3 | 5/2008 |
| WO | WO 2008/154317 A1 | 12/2008 |
| WO | WO 2009/102470 A1 | 8/2009 |
| WO | WO 2009/145828 A2 | 12/2009 |

OTHER PUBLICATIONS (H. Guo et al., "Protein Tolerance to Random Amino Acid Change", PNAS 101(25): 9205-9210, Jun. 2004).*
EP Examination Report dated Jul. 12, 2012 from related application EP 09755183.2.
International Search Report and Written Opinion dated Jan. 29, 2010 for related case PCT/US2009/001974.
International Preliminary Report on Patentability dated Oct. 14, 2010 for related case PCT/US2010/001974.
International Preliminary Report on Patentability dated Apr. 12, 2012 for related case PCT/US2010/002659.
Perez-Arnaiz et al. (2009) "Functional importance of bacteriophage phi29 DNA polymerase residue Tyr148 in primer-terminus stabilisation at the 3'-5' exonuclease active site," J Mol Biol., 391 (5):797-807.
EP Search Report dated Aug. 12, 2011 from corresponding EP Application No. 09755183.2.
International Search Report and Written Opinion dated Aug. 31, 2011 from corresponding International Application No. PCT/US2010/002659.
Invitation to Pay Additional Fees dated Jun. 23, 2011 from corresponding International Application No. PCT/US2010/002659.
Alba (2001) "Protein Family Review: Replicative DNA Polymerases" Genome Biology 2(1): reviews 3002.1-3002.4.
Anand, V. S. and S. S. Patel (2006). "Transient state kinetics of transcription elongation by T7 RNA polymerase." J Biol Chem 281(47): 35677-85.
Arndt et al. (2001) "Insight into the Catalytic Mechanism of DNA Polymerase β: Structures of Intermediate Complexes." *Biochemistry*, 40: 5368-5375.
Arnold et al. (2004) "Polivirus RNA-dependent RNA polymerase(3pol): pre-ready-state kinetic analysis of ribonucleotide incorporation in the presence of Mn2+." *Biochemistry*, 43(18): 5138-5148.
Augustin et al. (2001) "Progress towards single-molecule sequencing: enzymatic synthesis of nucleotide-specifically labeled DNA" J. Biotechnol. 86:289-301.
Bakhtina et al. (2005) "Use of Viscogens, dNTPaS, and Rhodium (III) as Probes in Stopped-Flow Experiments to Obtain New Evidence for the Mechanism of Catalysis by DNA Polymerase." *Biochemistry*, 44(13): 5177-5187.
Berman, et al. (2007) "Structures of phi29 polymerase complexed with substrate: the mechanism of translocation in polymerases." *EMBO Journal* 26: 3494-3505.

Bernad et al. (1989) "A conserved 3'→5' exonuclease active site in prokaryotic and eukaryotic DNA polymerase," Cell, 59:219-228.
Blanco and Salas (1995) "Mutational Analysis of Bacteriophage φ29 DNA Polymerase." *Methods in Enzymology*, 262: 283-294.
Blasco et al. (1993) "φ29 DNA polymerase active site: Residue Asp249 of conserved amino acid motif "$Dx_2SLYP$" is critical for synthetic activities," J. Biol. Chem., 268(32):24106-24113.
Blasco et al. (1993) "φ29 DNA Polymerase Active Site: The conserved amino acid motif $Kx_3NSxYG$ is involved in template primer binding and dNTP selection." J. Biol. Chem., 268(22): 16763-16770.
Burgers et al. (2001) "Eukaryotic DNA polymerases: proposal for a revised nomenclature" J Biol Chem. 276(47): 43487-90.
Castro et al. (2007) "Two proton transfers in the transition state for nucleotidyl transfer catalyzed by RNA and DNA-dependent RNA and DNA polymerase." *Proceedings of the National Academy of Sciences, USA*, 104(11): 4267-4272.
Dahlberg, M. E. and S. J. Benkovic (1991). "Kinetic mechanism of DNA polymerase I (Klenow fragment): identification of a second conformational change and evaluation of the internal equilibrium constant." Biochemistry 30(20): 4835-4843.
De Vega et al. (1996) "Primer-terminus stabilization at the 3'-5' exonuclease active site of φ29 DNA polymerase. Involvement of two amino acid residues highly conserved in proofreading DNA polymerases," EMBO. J., 15(5):1182-1192.
De Vega et al. (1997) "An invariant lysine residue is involved in catalysis at the 3'-5' exonuclease active site of eukaryotic-type DNA polymerases," J. Mol. Biol., 270:65-78.
De Vega et al. (2010) "Improvement of φ29 DNA polymerase amplification performance by fusion of DNA binding motifs" Proc Natl Acad Sci USA 107(38):16506-16511.
Eid et al. (2009) "Real-time DNA sequencing from single polymerase molecules." *Science*, 323(5910): 133-138.
Gardner and Jack (1999) "Determinants of nucleotide sugar recognition in an archaeon DNA polymerase" Nucleic Acids Research 27(12):2545-2553.
Gardner et al. (2004) "Comparative Kinetics of Nucleotide Analog Incorporation by Vent DNA Polymerase" J. Biol. Chem. 279(12):11834-11842.
GenBank Accession No. P03680 "RecName: Full=DNA polymerase; AltName: Full=Early protein GP2," (May 31, 2011).
Giller et al. (2003) "Incorporation of reporter molecule-labeled nucleotides by DNA polymerases. I. Chemical synthesis of various reporter group-labeled 2'-deoxyribonucleoside-5'-triphosphates" Nucleic Acids Res. 31(10):2630-2635.
Guo et al. (2004) "Protein tolerance to random amino acid change," PNAS, 101(25):9205-9210.
Hsieh, J. C., S. Zinnen, et al. (1993). "Kinetic mechanism of the DNA-dependent DNA polymerase activity of human immunodeficiency virus reverse transcriptase." J Biol Chem 268(33): 24607-13.
Hübscher et al. (2002) "Eukaryotic DNA Polymerases" Annual Review of Biochemistry vol. 71: 133-163.
Ibbara et al. (2009) "Proofreading dynamics of a processive DNA polymerase," Embo J., 28(18):2794-2802.
Johnson (1986) "Rapid kinetic analysis of mechanochemical adenosinetriphosphatases" Methods Enzymol. 134:677-705.
Kamtekar et al. (2004) "Insights into strand displacement and processivity from the crystal structure of the protein-primed DNA polymerase of bacteriophage φ29" Mol. Cell 16(4): 609-618.
Kamtekar et al. (2006) "The φ29 DNA polymerase:protein-primer structure suggests a model for the initiation to elongation transition" EMBO J. 25(6):1335-43.
Korlach et al. (2008) "Long, Processive Enzymatic DNA Synthesis Using 100% Dye-Labeled Terminal Phosphate-Linked Nucleotides." *Nucleosides, Nucleotides and Nucleic Acids*, 27(9): 1072-1083.
Korlach et al. (2008) "Selective aluminum passive for targeted immobilization of single DNA polymerase molecules in zero-mode waveguide nanostructures." *Proceedings of the National Academy of Sciences, USA*, 105(4): 1176-1181.
Korlach et al. (2010) "Real-Time DNA Sequencing from Single Polymerase Molecules" Methods in Enzymology 472:431-455.

(56) References Cited

OTHER PUBLICATIONS

Lagunavicius et al. (2008) "Duality of polynucleotide substrates for Phi29 DNA poylmerase: 3'→ 5' RNase activity of the enzyme," RNA, 14(3):503-513.

Levene et al. (2003) "Zero-Mode Waveguides for Single-Molecule Analysis at High Concentrations." *Science*, 299: 682-686.

Lundquist et al. (2008) "Parallel confocal detection of single molecules in real time." *Optics Letters*, 33(9): 1026-1028.

Meijer et al. (2001) "φ29 Family of Phages" Microbiology and Molecular Biology Reviews, 65(2):261-287.

Miyake et al. (2008) "Real-Time Imaging of Single-Molecule Flourescence with a Zero-Mode Waveguide for the Analysis of Protein-Protein Interaction." *Analytical Chemistry* 80(15):.6018-6022.

Ngo et al. (1994) "Computational complexity, protein structure prediction, and the Levinthal paradox," The Protein Folding Problem and Tertiary Structure Prediction, 433 and 492-495.

Nicholson et al. (1988) "Enhanced protein thermostability from designed mutations that interact with alpha-helix dipoles." *Nature*, 336: 651-656.

Nicholson et al. (1991) "Analysis of the Interaction between Charged Side Chains and the α-Helix Dipole Using Designed Thermostable Mutants of Phage T4 Lysozyme" Biochemistry 30:9816-9828.

Patel, S. S., I. Wong, et al. (1991). "Pre-steady-state kinetic analysis of processive DNA replication including complete characterization of an exonuclease-deficient mutant." Biochemistry 30(2): 511-25.

Pérez-Arnaiz et al. (2010) "φ29 DNA Polymerase Active Site: Role of Residue Val250 as Metal—dNTP Complex Ligand and in Protein-Primed Initiation" J. Mol. Biol. 395:223-233.

Rechkunova et al. (2000) Thermostable DNA polymerase from *Thermus thernophilus* B35: influence of divalent metal ions on the interaction with deoxynucleoside triphosphates. *Biochemistry*, 65(5): 609-614.

Ried et al. (1992) "Simultaneous visualization of seven different DNA probes by in situ hybridization using combinatorial fluorescence and digital imaging microscopy" Proc. Natl Acad. Sci. USA, 89:1388-1392.

Rodriguez et al. (2003) "φ29 DNA polymerase residue Phe128 of the highly conserved (S/T)Lx$_2$h motif is required for a stable and functional interaction with the terminal protein," J. Mol. Biol. 325:85-97.

Rodriguez, et al. (2005) "A specific subdomain in φ29 polymerase confers both processivity and strand-displacement capacity" Proc Natl Acad Sci USA 102(18): 6407-6412.

Soengas et al. (1992) "Site-directed mutagenesis at the Exo III motif of φ29 DNA polymerase; overlapping structural domains for the 3'-5' exonuclease and strand-displacement activities." *The EMBO Journal*, 11(11): 4227-4237.

Steitz (1999) "DNA polymerases: structural diversity and common mechanisms" J Biol Chem 274(25):17395-17398.

Steitz, T. A. (2004). "The structural basis of the transition from initiation to elongation phases of transcription, as well as translocation and strand separation, by T7 RNA polymerase." Curr Opin Struct Biol 14(1): 4-9.

Steitz, T. A. (2006). "Visualizing polynucleotide polymerase machines at work." EMBO J 25(15): 3458-68.

Steitz, T. A. and Y. W. Yin (2004). "Accuracy, lesion bypass, strand displacement and translocation by DNA polymerases." Philos Trans R Soc Lond B Biol Sci 359(1441): 17-23.

Tang et al. (2008) "Mismatched dNTP Incorporation by DNA Polymerase β does not Proceed via Globally Different Conformational Pathways," *Nucleic Acids Research*, 36(9):2948-2957.

Tock et al. (2003) "Dynamic evidence for metal ion catalysis in the reaction mediated by a flap endonuclease." *The EMBO Journal*, 22(5): 995-1004.

Tonon et al. (2000) "Spectral karyotyping combined with locus-specific FISH simultaneously defines genes and chromosomes involved in chromosomal translocations" Genes, Chromosomes and Cancer 27:418-423.

Truniger et al. (2002) "a positively charged residue of φ29 DNA polymerase, highly conserved in DNA polymerases from families A and B, is involved in binding the incoming nucleotide." *Nucleic Acids Research*, 30(7): 1483-1894.

Truniger et al. (2004) "Two positively charged residues of φ29 DNA polymerase, conserved in protein-primed DNA polymerases, are involved in stabilisation of the incoming nucleotide," J. Mol. Biol., 335:481-494.

Truniger, et al. (2004) "Function of the C-terminus of φ29 DNA polymerase in DNA and terminal protein binding" Nucleic Acids Research 32(1): 361-370.

Tsai and Johnson (2006) "A new paradigm for DNA polymerase specificity" Biochemistry 45(32):9675-9687.

Vaisman, A., H. Ling, et al. (2005). "Fidelity of Dpo4: effect of metal ions, nucleotide selection and pyrophosphorolysis." EMBO J 24(17): 2957-2967.

Washington, M. T., L. Prakash, et al. (2001). "Yeast DNA polymerase η utilizes an induced-fit mechanism of nucleotide incorporation." Cell 107(7): 917-927.

Xie et al. (1999) "Single-Molecule Enzymology." *Journal of Biological Chemistry*, 274(23) :15967-15970.

Yu et al. (1994) "Cyanine dye dUTP analogs for enzymatic labeling of DNA probes" Nucleic Acids Res. 22(15):3226-3232.

Zhou et al. (2007) "Kinetic Analysis of Sequential Multistep Reactions." *J Phys Chem B*. 111: 13600-13610.

Zhu and Waggoner (1997) "Molecular mechanism controlling the incorporation of fluorescent nucleotides into DNA by PCR" Cytometry, 28:206-211.

Zhu et al. (1994) "Directly labeled DNA probes using fluorescent nucleotides with different length linkers" Nucleic Acids Res. 22(16):3418-3422.

\* cited by examiner

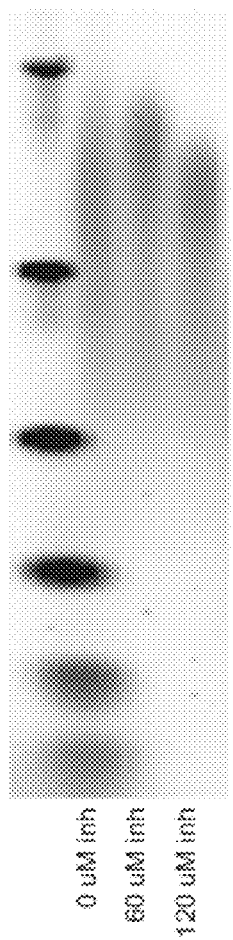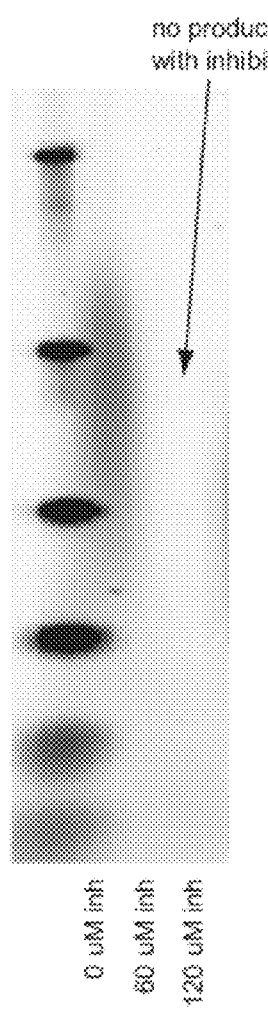

FIG. 23C

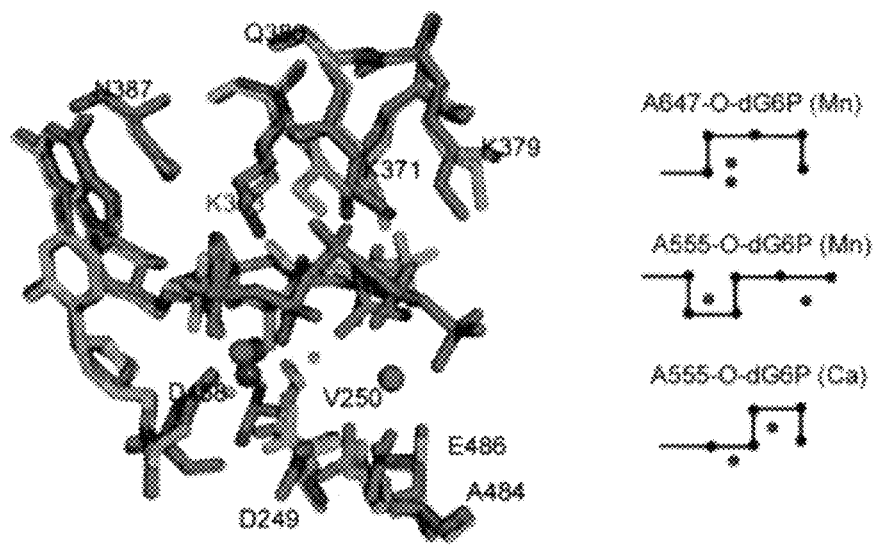

FIG. 23D 1) (active)
$1^{st}$, $2^{nd}$, $3^{rd}$ phosphate groups coordinates with Metal A and B.
$4^{th}$ and $5^{th}$ phosphate groups interact with K371 and K383

2) (inactive)
$1^{st}$, $2^{nd}$, $3^{rd}$ phosphate groups coordinates with Metal B.
$5^{th}$ and $6^{th}$ phosphate groups coordinates with Metal C
$1^{st}$ phosphate groups interact with N387.
$4^{th}$ and $5^{th}$ phosphate groups interact with K371, K379, K383 and Q380

3) (inactive)
$1^{st}$ and $2^{nd}$ phosphate groups coordinate with Metal A.
$2^{nd}$, $3^{rd}$ and $4^{th}$ phosphate groups interact with Metal D.
$4^{th}$ and $5^{th}$ phosphate group interact with K371 and K379

| Description |
|---|
| phi29co.His10.Xa.N62D_A134G_Q183S_T368F_E375Y_Y390V_W436Y_Y505T_M508L_K512Y |
| phi29co.His10.Xa.N62D_K143D_T368F_E375Y_Y390V_W436Y_Y505T_K512Y |
| phi29co.His10.Xa.N62D_F128M_T368F_E375Y_Y390V_W436Y_Y505T_K512Y |
| phi29co.His10.Xa.N62D_T368F_E375Y_Y390V_W436Y_Y505V_K512Y |
| phi29co.His10.Xa.N62D_T368F_E375Y_Y390V_W436Y_Y505V_M508L_K512Y |
| phi29co.His10.Xa.N62D_K143D_T368F_E375Y_Y390V_W436Y_Y505T_M508D_K512Y |
| phi29co.His10.Xa.N62D_K143D_T368F_E375Y_Y390V_W436Y_Y505T_M508L_K512Y |
| phi29co.His10.Xa.N62D_T368F_E375Y_Y390V_W436Y_Y505T_K512Y |
| phi29co.His10.Xa.N62D_F128M_S252L_L253A_T368F_K371H_E375Y_Y390V_W436Y_M508L_K512Y |
| phi29co.His10.Xa.N62D_K143D_Q183S_T368F_E375Y_Y390V_W436Y_Y505T_M508L_K512Y |
| phi29co.His10.Xa.N62D_T368F_E375Y_Y390V_W436Y_Y505T_M508D_K512Y |
| phi29co.His10.Xa.N62D_F128M_F137R_T368F_E375Y_Y390V_W436Y_Y505V_M508L_K512Y |
| phi29co.His10.Xa.N62D_Q183S_T368F_E375Y_Y390V_W436Y_Y505T_M508L_K512Y |
| phi29co.His10.Xa.N62D_F128M_K143D_S252L_L253A_T368F_E375Y_Y390V_W436Y_M508L_K512Y |
| phi29co.His10.Xa.N62D_Y254A_T368F_E375Y_Y390V_W436Y_Y505V_M508L_K512Y |
| phi29co.His10.Xa.N62D_F137P_K143D_L253A_T368F_K371W_E375Y_Y390V_W436Y_M508L_K512Y |
| phi29co.His10.Xa.N62D_Y254A_T368F_E375Y_Y390V_W436Y_Y505V_K512Y |
| phi29co.His10.Xa.N62D_K143D_Q183S_T368F_E375Y_Y390V_W436Y_Y505T_K512Y |
| phi29co.His10.Xa.N62D_F137K_Q183S_T368F_E375Y_Y390V_W436Y_Y505T_M508L_K512Y |
| phi29co.His10.Xa.N62D_T368F_E375Y_Y390V_W436Y_Y505T_M508L_K512Y |
| phi29co.His10.Xa.N62D_Q183S_T368F_E375Y_Y390V_W436Y_Y505T_K512Y |
| phi29co.His10.Xa.N62D_L253A_Y254A_T368F_K371H_E375Y_Y390V_W436Y_M508L_K512Y |
| phi29co.His10.Xa.N62D_F128M_T368F_E375Y_Y390V_W436Y_Y505V_M508L_K512Y |
| phi29co.His10.Xa.N62D_K143D_Q183S_T368F_E375Y_Y390V_W436Y_Y505T_M508D_K512Y |
| phi29co.His10.Xa.N62D_F128M_L253A_Y254A_T368F_E375Y_Y390V_W436Y_M508L_K512Y |
| phi29co.His10.Xa.N62D_A484Q |
| phi29co.His10.Xa.N62D_T368F_E375Y_W483L_H485Q_K512Y |
| phi29co.His10.Xa.N62D_T368F_E375Y_W483V_H485P_K512Y_K547N |
| phi29co.His10.Xa.N62D_T368F_E375Y_W483L_H485K_K512Y |
| phi29co.His10.Xa.N62D_T368F_E375Y_W483L_H485A_K512Y |
| phi29co.His10.Xa.N62D_T368F_E375Y_W483F_H485R_K512Y |
| phi29co.His10.Xa.N62D_T368F_E375Y_W483L_H485L_K512Y |
| phi29co.His10.Xa.N62D_T368F_E375Y_W483F_H485P_K512Y |
| phi29co.His10.Xa.N62D_T368F_E375Y_W483L_H485T_K512Y |
| phi29co.His10.Xa.N62D_T368F_E375Y_W483A_H485P_K512Y |
| phi29co.His10.Xa.N62D_T368F_E375Y_W483L_H485R_K512Y |
| phi29co.His10.Xa.N62D_T368F_E375Y_W483L_H485P_K512Y |
| phi29co.His10.Xa.N62D_T368F_E375Y_W483F_H485A_K512Y |
| phi29co.His10.Xa.N62D_T368F_E375Y_W483L_H485I_K512Y |
| phi29co.His10.Xa.N62D_T368F_E375Y_W483L_H485F_K512Y |
| phi29co.His10.Xa.N62D_T368F_E375Y_W483F_H485Q_K512Y |
| phi29co.His10.Xa.N62D_F137N_T368F_E375Y_I378L_K512Y |
| phi29co.His10.Xa.N62D_T368F_E375Y_I378T_K512Y |
| phi29co.His10.Xa.N62D_F137D_T368F_E375Y_I378K_K512Y |
| phi29co.His10.Xa.N62D_F137A_T368F_E375Y_I378E_K512Y |
| phi29co.His10.Xa.N62D_F137G_T368F_E375Y_I378K_K512Y |
| phi29co.His10.Xa.N62D_F137N_T368F_E375Y_I378E_K512Y |

Fig. 34

| Description |
|---|
| phi29cp.His10-Xa.N62D_F137N_T368F_E375Y_I378G_K512Y. |
| phi29cp.His10-Xa.N62D_F137A_T368F_E375Y_I378K_K512Y. |
| phi29cp.His10-Xa.N62D_F137A_T368F_E375Y_I378G_K512Y. |
| phi29cp.His10-Xa.N62D_T368F_E375Y_I378F_K512Y. |
| phi29cp.His10-Xa.N62D_F137Q_T368F_E375Y_I378Q_K512Y. |
| phi29cp.His10-Xa.N62D_T368F_E375Y_I378P_K512Y. |
| phi29cp.His10-Xa.N62D_F137G_T368F_E375Y_I378R_K512Y. |
| phi29cp.His10-Xa.N62D_F137N_T368F_E375Y_I378R_K512Y. |
| phi29cp.His10-Xa.N62D_F137N_T368F_E375Y_I378P_K512Y. |
| phi29cp.His10-Xa.N62D_F137A_T368F_E375Y_I378V_K512Y. |
| phi29cp.His10-Xa.N62D_F137R_T368F_E375Y_I378G_K512Y. |
| phi29cp.His10-Xa.N62D_F137L_T368F_E375Y_I378V_K512Y. |
| phi29cp.His10-Xa.N62D_F137K_T368F_E375Y_I378K_K512Y. |
| phi29cp.His10-Xa.N62D_F137L_T368F_E375Y_I378D_K512Y. |
| phi29cp.His10-Xa.N62D_F137L_T368F_E375Y_I378P_K512Y. |
| phi29cp.His10-Xa.N62D_F137N_T368F_E375Y_I378Q_K512Y. |
| phi29cp.His10-Xa.N62D_F137G_T368F_E375Y_I378P_K512Y. |
| phi29cp.His10-Xa.N62D_T368F_E375Y_I378A_K512Y. |
| phi29cp.His10-Xa.N62D_F137K_T368F_E375Y_I378N_K512Y. |
| phi29cp.His10-Xa.N62D_F137A_T368F_E375Y_I378L_K512Y. |
| phi29cp.His10-Xa.N62D_F137G_T368F_E375Y_I378A_K512Y. |
| phi29cp.His10-Xa.N62D_F137S_T368F_E375Y_I378R_K512Y. |
| phi29cp.His10-Xa.N62D_G245S_T368F_E375Y_I378K_K512Y. |
| phi29cp.His10-Xa.N62D_F137Q_T368F_E375Y_I378S_K512Y. |
| phi29cp.His10-Xa.N62D_F137Q_T368F_E375Y_I378P_K512Y. |
| phi29cp.His10-Xa.N62D_F137G_T368F_E375Y_I378L_K512Y. |
| phi29cp.His10-Xa.N62D_F137N_D219N_T368F_E375Y_I378A_K512Y. |
| phi29cp.His10-Xa.N62D_F137Q_T368F_E375Y_I378E_K512Y. |
| phi29cp.His10-Xa.N62D_T368F_E375Y_I378G_K512Y. |
| phi29cp.His10-Xa.N62D_T368F_E375Y_I378L_K512Y. |
| phi29cp.His10-Xa.N62D_F137L_T368F_E375Y_I378G_K512Y. |
| phi29cp.His10-Xa.N62D_F137L_G245S_T368F_E375Y_I378P_K512Y. |
| phi29cp.His10-Xa.N62D_T368F_E375Y_I378R_K512Y. |
| phi29cp.His10-Xa.N62D_F137D_T368F_E375Y_I378R_K512Y. |
| phi29cp.His10-Xa.N62D_T368F_E375Y_I378E_K512Y. |
| phi29cp.His10-Xa.N62D_T368F_E375Y_I378G_K512Y. |
| phi29cp.His10-Xa.N62D_F137K_T368F_E375Y_I378G_K512Y. |
| phi29cp.His10-Xa.N62D_F137N_T368F_E375Y_I378A_K512Y. |
| phi29cp.His10-Xa.N62D_F137R_T368F_E375Y_I378E_K512Y. |
| phi29cp.His10-Xa.N62D_F137A_T368F_E375Y_I378N_K512Y. |
| phi29cp.His10-Xa.N62D_T368F_E375Y_K512Y. |
| phi29cp.His10-Xa.N62D_F137G_T368F_E375Y_I378K_K512Y_F546Y. |
| phi29cp.His10-Xa.N62D_F137V_T368F_E375Y_I378F_K512Y. |
| phi29cp.His10-Xa.N62D_F137Q_T368F_E375Y_I378F_K512Y. |
| phi29cp.His10-Xa.N62D_F137Q_T368F_E375Y_I378N_K512Y. |
| phi29cp.His10-Xa.N62D_W232L_T368F_E375Y_K512Y. |
| phi29cp.His10-Xa.N62D_F230V_W232F_T368F_E375Y_K512Y. |
| phi29cp.His10-Xa.N62D_F230I_W232F_T368F_E375Y_K512Y. |

Fig. 34 (cont.)

| Description |
|---|
| phi29co.His10-Xa.N62D_P290K_W232V_T368F_E375Y_K512Y. |
| phi29co.His10-Xa.N62D_W232F_T368F_E375Y_K512Y. |
| phi29co.His10-Xa.N62D_P300T_Y315P_T368F_E375Y_K512Y. |
| phi29co.His10-Xa.N62D_P300N_Y315L_T368F_E375Y_K512Y. |
| phi29co.His10-Xa.N62D_P300Q_Y315N_T368F_E375Y_K512Y. |
| phi29co.His10-Xa.N62D_Y315R_T368F_E375Y_K512Y. |
| phi29co.His10-Xa.N62D_Y315P_T368F_E375Y_K512Y. |
| phi29co.His10-Xa.N62D_Y315I_T368F_E375Y_K512Y. |
| phi29co.His10-Xa.N62D_P300Q_Y315T_T368F_E375Y_K512Y. |
| phi29co.His10-Xa.N62D_P300Q_Y315K_T368F_E375Y_K512Y. |
| phi29co.His10-Xa.N62D_P300T_Y315E_T368F_E375Y_K512Y. |
| phi29co.His10-Xa.N62D_P300Q_Y315Q_T368F_E375Y_K512Y. |
| phi29co.His10-Xa.N62D_P300A_Y315K_T368F_E375Y_K512Y. |
| phi29co.His10-Xa.N62D_P300G_Y315V_T368F_E375Y_K512Y. |
| phi29co.His10-Xa.N62D_Y315L_T368F_E375Y_K512Y. |
| phi29co.His10-Xa.N62D_P300E_Y315V_T368F_E375Y_K512Y. |
| phi29co.His10-Xa.N62D_P300T_Y315A_T368F_E375Y_K512Y. |
| phi29co.His10-Xa.N62D_P300G_Y315S_T368F_E375Y_K512Y. |
| phi29co.His10-Xa.N62D_Y315Q_T368F_E375Y_K512Y. |
| phi29co.His10-Xa.N62D_P300S_Y315S_T368F_E375Y_K512Y. |
| phi29co.His10-Xa.N62D_P300A_Y315G_T368F_E375Y_K512Y. |
| phi29co.His10-Xa.N62D_P300A_Y315D_T368F_E375Y_K512Y. |
| phi29co.His10-Xa.N62D_P300D_Y315E_T368F_E375Y_K512Y. |
| phi29co.His10-Xa.N62D_P300A_Y315Q_T368F_E375Y_K512Y. |
| phi29co.His10-Xa.N62D_P300T_Y315F_T368F_E375Y_K512Y. |
| phi29co.His10-Xa.N62D_P300A_Y315T_T368F_E375Y_K512Y. |
| phi29co.His10-Xa.N62D_P300A_Y315L_T368F_E375Y_K512Y. |
| phi29co.His10-Xa.N62D_Y505G_M508K_Y521A. |
| phi29co.His10-Xa.N62D_Y505K_M508A_Y521T. |
| phi29co.His10-Xa.N62D_Y505L_M508L_Y521A. |
| phi29co.His10-Xa.N62D_T443M_Y505K_M508P_Y521T. |
| phi29co.His10-Xa.N62D_Y505Q_M508L_Y521A. |
| phi29co.His10-Xa.N62D_Y505T_M508T_Y521L. |
| phi29co.His10-Xa.N62D_Y505K_M508P_Y521T. |
| phi29co.His10-Xa.N62D_Y505T_M508P_Y521F. |
| phi29co.His10-Xa.N62D_Y505T_M508K_Y521F. |
| phi29co.His10-Xa.N62D_Y505V_M508H_Y521A. |
| phi29co.His10-Xa.N62D_Y505S_M508P_Y521A. |
| phi29co.His10-Xa.N62D_Y505L_M508I_Y521L. |
| phi29co.His10-Xa.N62D_Y505Q_M508P_Y521F. |
| phi29co.His10-Xa.N62D_Y505T_M508K_Y521T. |
| phi29co.His10-Xa.N62D_M508L_Y521L. |
| phi29co.His10-Xa.N62D_Y505T_M508A_Y521A. |
| phi29co.His10-Xa.N62D_Y505V_M508L. |
| phi29co.His10-Xa.N62D_Y505T_M508P_Y521L. |
| phi29co.His10-Xa.N62D_K195_Y505G_M508P_Y521A. |
| phi29co.His10-Xa.N62D_Y505T_M508T. |
| phi29co.His10-Xa.N62D_Y505T_M508P_Y521L. |

Fig. 34 (cont.)

| Description |
|---|
| phi29cc.His10.Xa.N62D_Y505I_M506P_Y521A. |
| phi29cc.His10.Xa.N62D_Y505T_M506L_Y521L. |
| phi29cc.His10.Xa.N62D_Y505V_M506P_Y521L. |
| phi29cc.His10.Xa.N62D_Y505T_M506A_Y521L. |
| phi29cc.His10.Xa.N62D_Y505V_M506P_Y521L. |
| phi29cc.His10.Xa.N62D_Y505V_M506L_Y521A. |
| phi29cc.His10.Xa.N62D_Y505T_Y521L. |
| phi29cc.His10.Xa.N62D_Y505K_M506L_Y521A. |
| phi29cc.His10.Xa.N62D_Y505T_M506P. |
| phi29cc.His10.Xa.N62D_Y505G_M506P. |
| phi29cc.His10.Xa.N62D_Y505S_M506L. |
| phi29cc.His10.Xa.N62D_Y505L_M506A_Y521A. |
| phi29cc.His10.Xa.N62D_Y505N_M506T_Y521F. |
| phi29cc.His10.Xa.N62D_Y505_M506P_Y521L. |
| phi29cc.His10.Xa.N62D_Y505K_M506P_Y521A. |
| phi29cc.His10.Xa.N62D_Y505V_M506L_Y521L. |
| phi29cc.His10.Xa.N62D_M506P_Y521T. |
| phi29cc.His10.Xa.N62D_Y505T_M506P_Y521A. |
| phi29cc.His10.Xa.N62D_Y505V_M506P_Y521F. |
| phi29cc.His10.Xa.N62D_Y505T_M506T_Y521F. |
| phi29cc.His10.Xa.N62D_Y505I_M506T_Y521L. |
| phi29cc.His10.Xa.N62D_Y505L_M506T. |
| phi29cc.His10.Xa.N62D_Y505T_M506T_V514_Y521A. |
| phi29cc.His10.Xa.N62D_M506P_Y521L. |
| phi29cc.His10.Xa.N62D_Y505V_M506P. |
| phi29cc.His10.Xa.N62D_Y505K_M506P_Y521L. |
| phi29cc.His10.Xa.N62D_Y505V_M506T_Y521F. |
| phi29cc.His10.Xa.N62D_Y505I_M506P. |
| phi29cc.His10.Xa.N62D_Y505Q_M506P_Y521A. |
| phi29cc.His10.Xa.N62D_M506I_Y521A. |
| phi29cc.His10.Xa.N62D_Y505T_M506H_Y521A. |
| phi29cc.His10.Xa.N62D_Y505T_M506A. |
| phi29cc.His10.Xa.N62D_Y505D_M506P. |
| phi29cc.His10.Xa.N62D_Y505K_M506P. |
| phi29cc.His10.Xa.N62D_Y505T_M506P_Y521T. |
| phi29cc.His10.Xa.N62D_Y505T_M506K_Y521A. |
| phi29cc.His10.Xa.N62D_Y505S_M506A_Y521F. |
| phi29cc.His10.Xa.N62D_Y505L_M506P_Y521L. |
| phi29cc.His10.Xa.N62D_Y505G_M506A_Y521T. |
| phi29cc.His10.Xa.N62D_Y505S_M506H_Y521L. |
| phi29cc.His10.Xa.N62D_Y505S_M506H_Y521A. |
| phi29cc.His10.Xa.N62D_Y505T_Y521T. |
| phi29cc.His10.Xa.N62D_Y505S_M506V. |
| phi29cc.His10.Xa.N62D_Y505T_M506H_Y521L. |
| phi29cc.His10.Xa.N62D_K512Y_L567R. |
| phi29cc.His10.Xa.N62D_T368F_E375Y_K512Y_K555R_L567Q. |
| phi29cc.His10.Xa.N62D_T368F_E375Y_K512Y_K555C. |
| phi29cc.His10.Xa.N62D_T368F_E375Y_K512Y_K555T_L567D. |

Fig. 34 (cont.)

| Description |
|---|
| phi29co.His10-Xa_N62D_T368F_E375Y_K512Y_K555C_L567S |
| phi29co.His10-Xa_N62D_T368F_E375Y_K512Y_L567Y |
| phi29co.His10-Xa_N62D_T368F_E375Y_K512Y_K555I_L567K |
| phi29co.His10-Xa_N62D_T368F_E375Y_K512Y_K555D_L567W |
| phi29co.His10-Xa_N62D_T368F_E375Y_K512Y_K555P_L567S |
| phi29co.His10-Xa_N62D_T368F_E375Y_K512Y_K555E_L567A |
| phi29co.His10-Xa_N62D_T368F_E375Y_K512Y_K555D_L567K |
| phi29co.His10-Xa_N62D_T368F_E375Y_K512Y_K555S_L567H |
| phi29co.His10-Xa_N62D_T368F_E375Y_K512Y_K555P_L567R |
| phi29co.His10-Xa_N62D_T368F_E375Y_K512Y_K555S_L567G |
| phi29co.His10-Xa_N62D_T368F_E375Y_K512Y_K555A_L567S |
| phi29co.His10-Xa_N62D_T368F_E375Y_K512Y_K555A_L567K |
| phi29co.His10-Xa_N62D_T368F_E375Y_K512Y_K555D |
| phi29co.His10-Xa_N62D_T368F_E375Y_K512Y_K555E_L567W |
| phi29co.His10-Xa_N62D_T368F_E375Y_K512Y_K555A |
| phi29co.His10-Xa_N62D_T368F_E375Y_K512Y_K555T_L567Q |
| phi29co.His10-Xa_N62D_T368F_E375Y_K512Y_K555D_L567D |
| phi29co.His10-Xa_N62D_T368F_E375Y_K512Y_K555S_L567Q |
| phi29co.His10-Xa_N62D_T368F_E375Y_K512Y_K555A_L567E |
| phi29co.His10-Xa_N62D_T368F_E375Y_K512Y_K555T |
| phi29co.His10-Xa_N62D_T368F_E375Y_K512Y_K555Q_L567H |
| phi29co.His10-Xa_N62D_T368F_E375Y_K512Y_K555E |
| phi29co.His10-Xa_N62D_T368F_E375Y_K512Y_K555P_L567K |
| phi29co.His10-Xa_N62D_T368F_E375Y_K512Y_K555Q |
| phi29co.His10-Xa_N62D_T368F_E375Y_K512Y_K555I_L567N |
| phi29co.His10-Xa_N62D_T368F_E375Y_K512Y_K555D_K557A_P558A |
| phi29co.His10-Xa_N62D_T368F_E375Y_K512Y_L567A |
| phi29co.His10-Xa_N62D_T368F_E375Y_K512Y_K555A_L567H |
| phi29co.His10-Xa_N62D_T368F_E375Y_K512Y_K555S_L567R |
| phi29co.His10-Xa_N62D_T368F_E375Y_K512Y_K555Q_L567G |
| phi29co.His10-Xa_N62D_T368F_E375Y_K512Y_K555T_L567K |
| phi29co.His10-Xa_N62D_T368F_E375Y_K512Y_L567I |
| phi29co.His10-Xa_N62D_T368F_E375Y_K512Y_K555G_L567I |
| phi29co.His10-Xa_D12Y_N62D_T368F_E375Y_K512Y_K555V_L567A |
| phi29co.His10-Xa_N62D_T368F_E375Y_K512Y_K555S_L567P |
| phi29co.His10-Xa_N62D_T368F_E375Y_K512Y_K555E_L567Q |
| phi29co.His10-Xa_N62D_T368F_E375Y_K512Y_K555Q_L567R |
| phi29co.His10-Xa_N62D_T368F_E375Y_K512Y_K555E_L567P |
| phi29co.His10-Xa_N62D_E375Y_K379S_K512Y_K555E_Q560R_L567P |
| phi29co.His10-Xa_N62D_T368F_E375Y_K512Y_K555T_L567S |
| phi29co.His10-Xa_N62D_T368F_E375Y_K512Y_K555C_L567R |
| phi29co.His10-Xa_N62D_T368F_E375Y_K512Y_L567N |
| phi29co.His10-Xa_N62D_T368F_E375Y_K512Y_K555T_L567P |
| phi29co.His10-Xa_N62D_T368F_E375Y_K512Y_K555V_L567P |
| phi29co.His10-Xa_N62D_T368F_E375Y_K512Y_L567K |
| phi29co.His10-Xa_N62D_T368F_E375Y_K512Y_K555S_L567G |
| phi29co.His10-Xa_N62D_T368F_E375Y_K512Y_K555N_L567T |
| phi29co.His10-Xa_N62D_T368F_E375Y_K512Y_K555T_L567H |

Fig. 34 (cont.)

| Description |
|---|
| phi29cc.His10.Xa.N62D_T368F_E375Y_K512Y_L567H |
| phi29cc.His10.Xa.N62D_T368F_E375Y_K512Y_K555N |
| phi29cc.His10.Xa.N62D_T368F_E375Y_K512Y_K555T_L567R |
| phi29cc.His10.Xa.N62D_T368F_E375Y_K512Y_K555R_L567H |
| phi29cc.His10.Xa.N62D_T368F_E375Y_K512Y_K555L |
| phi29cc.His10.Xa.N62D_T368F_E375Y_K512Y_L567E |
| phi29cc.His10.Xa.N62D_T368F_E375Y_K512Y_K555T_L567S |
| phi29cc.His10.Xa.N62D_T368F_E375Y_K512Y_K555Q_L567S |
| phi29cc.His10.Xa.N62D_T368F_E375Y_K512Y_K555Q_L567M |
| phi29cc.His10.Xa.N62D_T368F_E375Y_K512Y_K555A_L567A |
| phi29cc.His10.Xa.N62D_T368F_E375Y_K512Y_K555Q_L567P |
| phi29cc.His10.Xa.N62D_T368F_E375Y_K512Y_K555R_L567S |
| phi29cc.His10.Xa.N62D_T368F_E375Y_K512Y_K555S |
| phi29cc.His10.Xa.N62D_T368F_E375Y_K512Y_K555S_L567A |
| phi29cc.His10.Xa.N62D_T368F_E375Y_K512Y_K555C_L567Q |
| phi29cc.His10.Xa.N62D_T368F_E375Y_K512Y_L567Y |
| phi29cc.His10.Xa.N62D_T368F_E375Y_K512Y_K555C_L567E |
| phi29cc.His10.Xa.N62D_T368F_E375Y_K512Y_K555T_L567V |
| phi29cc.His10.Xa.N62D_T368F_E375Y_K512Y_K555Q |
| phi29cc.His10.Xa.N62D_T368F_E375Y_K512Y_K555S_L567Y |
| phi29cc.His10.Xa.N62D_T368F_E375Y_K512Y_K555H_L567Q |
| phi29cc.His10.Xa.N62D_T368F_E375Y_K512Y_K555N_L567D |
| phi29cc.His10.Xa.N62D_F128G_T368F_E375Y_A377Q_K512Y |
| phi29cc.His10.Xa.N62D_F128A_T368F_E375Y_A377L_K512Y |
| phi29cc.His10.Xa.N62D_F128A_T368F_E375Y_A377R_K512Y |
| phi29cc.His10.Xa.N62D_F128L_T368F_E375Y_A377Q_K512Y |
| phi29cc.His10.Xa.N62D_F128S_T368F_E375Y_A377S_K512Y |
| phi29cc.His10.Xa.N62D_F128H_T368F_E375Y_A377N_K512Y |
| phi29cc.His10.Xa.N62D_F128R_T368F_E375Y_A377S_K512Y |
| phi29cc.His10.Xa.N62D_F128A_T368F_E375Y_A377N_K512Y |
| phi29cc.His10.Xa.N62D_F128T_T368F_E375Y_A377H_K512Y |
| phi29cc.His10.Xa.N62D_F128G_T368F_E375Y_A377H_K512Y |
| phi29cc.His10.Xa.N62D_F128A_T368F_E375Y_A377Y_K512Y |
| phi29cc.His10.Xa.N62D_F128L_T368F_E375Y_A377N_K512Y |
| phi29cc.His10.Xa.N62D_T368F_E375Y_A377R_K512Y |
| phi29cc.His10.Xa.N62D_F128E_T368F_E375Y_A377Q_K512Y |
| phi29cc.His10.Xa.N62D_F128D_T368F_E375Y_A377P_K512Y |
| phi29cc.His10.Xa.N62D_F128N_T368F_E375Y_A377Q_K512Y |
| phi29cc.His10.Xa.N62D_F128A_T368F_E375Y_A377Y_K512Y |
| phi29cc.His10.Xa.N62D_F128D_T368F_E375Y_A377Q_K512Y |
| phi29cc.His10.Xa.N62D_F128K_T368F_E375Y_A377R_K512Y |
| phi29cc.His10.Xa.N62D_F128S_T368F_E375Y_A377H_K512Y |
| phi29cc.His10.Xa.N62D_F128E_T368F_E375Y_A377S_K512Y |
| phi29cc.His10.Xa.N62D_F128L_T368F_E375Y_A377H_K512Y |
| phi29cc.His10.Xa.N62D_F128E_T368F_E375Y_A377N_K512Y |
| phi29cc.His10.Xa.N62D_F128H_T368F_E375Y_A377Q_K512Y |
| phi29cc.His10.Xa.N62D_F128A_T368F_E375Y_A377T_K512Y |
| phi29cc.His10.Xa.N62D_F128A_T368F_E375Y_A377S_K512Y |

Fig. 34 (cont.)

| Description |
|---|
| phi29xo.His10-Xa.N62D_F128E_T368F_E375Y_A377H_K512Y. |
| phi29xo.His10-Xa.N62D_F128K_T368F_E375Y_A377C_K512Y. |
| phi29xo.His10-Xa.N62D_F128T_T368F_E375Y_A377R_K512Y. |
| phi29xo.His10-Xa.N62D_F128D_T368F_E375Y_A377T_K512Y. |
| phi29xo.His10-Xa.N62D_F128R_T368F_E375Y_A377R_K512Y. |
| phi29xo.His10-Xa.N62D_F128Y_T368F_E375Y_A377S_K512Y. |
| phi29xo.His10-Xa.N62D_F128A_T368F_E375Y_A377E_K512Y. |
| phi29xo.His10-Xa.N62D_F128Q_T368F_E375Y_A377N_K512Y. |
| phi29xo.His10-Xa.N62D_F128M_T368F_E375Y_A377R_K512Y. |
| phi29xo.His10-Xa.N62D_F128P_T368F_E375Y_A377W_K512Y. |
| phi29xo.His10-Xa.N62D_F128D_T368F_E375Y_A377K_K512Y. |
| phi29xo.His10-Xa.N62D_F128C_T368F_E375Y_K512Y. |
| phi29xo.His10-Xa.N62D_F128N_T368F_E375Y_A377S_K512Y. |
| phi29xo.His10-Xa.N62D_F128I_T368F_E375Y_K512Y. |
| phi29xo.His10-Xa.N62D_F128L_T368F_E375Y_K512Y. |
| phi29xo.His10-Xa.N62D_F128T_T368F_E375Y_K512Y. |
| phi29xo.His10-Xa.N62D_F128A_T368F_E375Y_A377Q_K512Y. |
| phi29xo.His10-Xa.N62D_F128V_T368F_E375Y_A377E_K512Y. |
| phi29xo.His10-Xa.N62D_F128C_T368F_E375Y_A377R_K512Y. |
| phi29xo.His10-Xa.N62D_F128Q_T368F_E375Y_A377S_K512Y. |
| phi29xo.His10-Xa.N62D_F128E_T368F_E375Y_A377D_K512Y. |
| phi29xo.His10-Xa.N62D_F128I_T368F_E375Y_A377R_K512Y. |
| phi29xo.His10-Xa.N62D_F128G_T368F_E375Y_A377S_K512Y_T571S. |
| phi29xo.His10-Xa.N62D_F128G_T368F_E375Y_A377S_K512Y. |
| phi29xo.His10-Xa.N62D_F128G_T368F_E375Y_A377M_K512Y. |
| phi29xo.His10-Xa.N62D_F128L_T368F_E375Y_A377V_K512Y. |
| phi29xo.His10-Xa.N62D_T368F_E375Y_A377K_K512Y. |
| phi29xo.His10-Xa.N62D_F128H_T368F_E375Y_A377K_K512Y. |
| phi29xo.His10-Xa.N62D_F128A_T368F_E375Y_A377H_K512Y. |
| phi29xo.His10-Xa.N62D_F128V_T368F_E375Y_A377G_K512Y. |
| phi29xo.His10-Xa.N62D_T368F_E375Y_A377V_K512Y_T571I_T573L_I574L. |
| phi29xo.His10-Xa.N62D_F128P_T368F_E375Y_A377Q_K512Y. |
| phi29xo.His10-Xa.N62D_T368F_E375Y_A377V_K512Y. |
| phi29xo.His10-Xa.N62D_F128V_T368F_E375Y_A377T_K512Y. |
| phi29xo.His10-Xa.N62D_F128A_T368F_E375Y_A377E_K512Y_T573Y_I574Y. |
| phi29xo.His10-Xa.N62D_F128C_T368F_E375Y_K512Y_T573Y_I574Y. |
| phi29xo.His10-Xa.N62D_F128Y_T368F_E375Y_A377Q_K512Y_T571N_T573Y_I574Y. |
| phi29xo.His6-Xa.D12A_N62D_T372D_E375W. |
| phi29xo.His6-Xa.D12A_N62D_T372E_E375W. |
| phi29xo.His6-Xa.D12A_N62D_T372R_E375W_K478D. |
| phi29xo.His6-Xa.D12A_N62D_T372R_E375W_K478E. |
| phi29xo.His6-Xa.D12A_N62D_T372K_E375W_K478D. |
| phi29xo.His6-Xa.D12A_N62D_T372K_E375W_K478E. |
| phi29xo.His6-Xa.D12A_N62D_K135D_E375W. |
| phi29xo.His6-Xa.D12A_N62D_K135E_E375W. |
| phi29xo.His6-Xa.D12A_N62D_E375W_K512D. |
| phi29xo.His6-Xa.D12A_N62D_E375W_K512E. |
| phi29xo.His6-Xa.D12A_N62D_E375W_E486K. |

Fig. 34 (cont.)

| Description |
|---|
| phi29op.His6-Xa.D12A_N62D_E375W_E408R |
| phi29op.His6-Xa.D12A_N62D_T368O_E375W_L480K |
| phi29op.His6-Xa.D12A_N62D_T368E_E375W_L480K |
| phi29op.His6-Xa.D12A_N62D_D458N |
| phi29op.Stag-His6-Xa.N62D_D458N |
| phi29op.His6-Xa.D12A_N62D_D458A |
| phi29op.Stag-His6-Xa.N62D_D458A |
| phi29op.His6-Xa.D12A_N62D_D458S |
| phi29op.Stag-His6-Xa.N62D_D458S |
| phi29op.Stag-His6-Xa.N62D_E375M |
| phi29op.Stag-His6-Xa.N62D_E375L |
| phi29op.Stag-His6-Xa.N62D_E375I |
| phi29op.Stag-His6-Xa.N62D_E375F |
| phi29op.Stag-His6-Xa.N62D_E375D |
| phi29op.His6-Xa.D12A_N62D_K512W |
| phi29op.Stag-His6-Xa.N62D_K512W |
| phi29op.His6-Xa.D12A_N62D_K512Y |
| phi29op.Stag-His6-Xa.N62D_K512Y |
| phi29op.His6-Xa.D12A_N62D_K512F |
| phi29op.Stag-His6-Xa.N62D_K512F |
| phi29op.His6-Xa.D12A_N62D_E375W_K512L |
| phi29op.Stag-His6-Xa.N62D_E375W_K512L |
| phi29op.D12A_N62D_E375W_K512Y |
| phi29op.Stag-His6-Xa.N62D_E375W_K512Y |
| phi29op.His6-Xa.D12A_N62D_E375W_K512F |
| phi29op.Stag-His6-Xa.N62D_E375W_K512F |
| phi29op.His6-Xa.D12A_N62D_E375Y_K512L |
| phi29op.Stag-His6-Xa.N62D_E375Y_K512L |
| phi29op.His6-Xa.D12A_N62D_E375Y_K512Y |
| phi29op.Stag-His6-Xa.N62D_E375Y_K512Y |
| phi29op.His6-Xa.D12A_N62D_E375Y_K512F |
| phi29op.Stag-His6-Xa.N62D_E375Y_K512F |
| phi29op.His6-Xa.D12A_N62D_E375W_K512H |
| phi29op.Stag-His6-Xa.N62D_E375W_K512H |
| phi29op.His6-Xa.D12A_N62D_E375Y_K512H |
| phi29op.Stag-His6-Xa.N62D_E375Y_K512H |
| phi29op.His6-Xa.D12A_N62D_D510F |
| phi29op.Stag-His6-Xa.N62D_D510F |
| phi29op.His6-Xa.D12A_N62D_D510Y |
| phi29op.Stag-His6-Xa.N62D_D510Y |
| phi29op.His6-Xa.D12A_N62D_D510W |
| phi29op.Stag-His6-Xa.N62D_D510W |
| phi29op.His6-Xa.D12A_N62D_E375W_D510F |
| phi29op.Stag-His6-Xa.N62D_E375W_D510F |
| phi29op.His6-Xa.D12A_N62D_E375W_D510Y |
| phi29op.Stag-His6-Xa.N62D_E375W_D510Y |
| phi29op.His6-Xa.D12A_N62D_E375W_D510W |
| phi29op.Stag-His6-Xa.N62D_E375W_D510W |

Fig. 34 (cont.)

| Description |
|---|
| ph29cc.Hs6-Xa.D12A_N62D_E375W_D519W_K512L |
| ph29cc.Bag-Hs6-Xa.N62D_E375W_D519W_K512L |
| ph29cc.Hs6-Xa.D12A_N62D_E375W_D519W_K512F |
| ph29cc.Bag-Hs6-Xa.N62D_E375W_D519W_K512F |
| ph29cc.Hs6-Xa.D12A_N62D_E375W_D519H |
| ph29cc.Bag-Hs6-Xa.N62D_E375W_D519H |
| ph29cc.Hs6-Xa.D12A_N62D_E375W_D519H_K512H |
| ph29cc.Bag-Hs6-Xa.N62D_E375W_D519H_K512H |
| ph29cc.Hs6-Xa.D12A_N62D_E375W_D519H_K512F |
| ph29cc.Bag-Hs6-Xa.N62D_E375W_D519H_K512F |
| ph29cc.Hs6-Xa.D12A_N62D_V509Y |
| ph29cc.Bag-Hs6-Xa.N62D_V509Y |
| ph29cc.Hs6-Xa.D12A_N62D_V509W |
| ph29cc.Bag-Hs6-Xa.N62D_V509W |
| ph29cc.Hs6-Xa.D12A_N62D_V509F |
| ph29cc.Bag-Hs6-Xa.N62D_V509F |
| ph29cc.Hs6-Xa.D12A_N62D_V514Y |
| ph29cc.Bag-Hs6-Xa.N62D_V514Y |
| ph29cc.Hs6-Xa.D12A_N62D_V514W |
| ph29cc.Bag-Hs6-Xa.N62D_V514W |
| ph29cc.Hs6-Xa.D12A_N62D_V514F |
| ph29cc.Bag-Hs6-Xa.N62D_V514F |
| ph29cc.Hs6-Xa.D12S_N62D |
| ph29cc.Hs6-Xa.D12N_N62D |
| ph29cc.Hs6-Xa.D12Q_N62D |
| ph29cc.Hs6-Xa.D12K_N62D |
| ph29cc..D12A_N62D |
| ph29cc.Hs6-Xa.D12A_N62D_D66A |
| ph29cc.Bag-Hs6-Xa.N62D_Y254F |
| ph29cc.Bag-Hs6-Xa.N62D_Y254V |
| ph29cc.Bag-Hs6-Xa.N62D_Y254A |
| ph29cc.Bag-Hs6-Xa.N62D_Y390F |
| ph29cc.Bag-Hs6-Xa.N62D_Y390A |
| ph29cc.Bag-Hs6-Xa.N62D_S252A |
| ph29cc.Bag-Hs6-Xa.N62D_T368M |
| ph29cc.Bag-Hs6-Xa.N62D_N387A |
| ph29cc.Bag-Hs6-Xa.N62D_T368G |
| ph29cc.Bag-Hs6-Xa.N62D_K157E |
| ph29cc.Bag-Hs6-Xa.N62D_I242H |
| ph29cc.Bag-Hs6-Xa.N62D_Y259S |
| ph29cc.Bag-Hs6-Xa.N62D_G323C |
| ph29cc.Bag-Hs6-Xa.N62D_L326V |
| ph29cc.Bag-Hs6-Xa.N62D_Y369R |
| ph29cc.Bag-Hs6-Xa.N62D_Y369H |
| ph29cc.Bag-Hs6-Xa.N62D_Y369E |
| ph29cc.Bag-Hs6-Xa.N62D_I370V |
| ph29cc.Bag-Hs6-Xa.N62D_I370K |
| ph29cc.Bag-Hs6-Xa.N62D_K371Q |

Fig. 34 (cont.)

| Description |
|---|
| phi29cc Stag-His6-Xa.N62D_T372N |
| phi29cc Stag-His6-Xa.N62D_T372Q |
| phi29cc Stag-His6-Xa.N62D_T372R |
| phi29cc Stag-His6-Xa.N62D_T372L |
| phi29cc Stag-His6-Xa.N62D_T373A |
| phi29cc Stag-His6-Xa.N62D_T373R |
| phi29cc Stag-His6-Xa.N62D_S374E |
| phi29cc Stag-His6-Xa.N62D_I378K |
| phi29cc Stag-His6-Xa.N62D_K379E |
| phi29cc Stag-His6-Xa.N62D_K379T_S517G |
| phi29cc Stag-His6-Xa.N62D_N387D |
| phi29cc Stag-His6-Xa.N62D_Y405V |
| phi29cc Stag-His6-Xa.N62D_E408D |
| phi29cc Stag-His6-Xa.N62D_G413D |
| phi29cc Stag-His6-Xa.N62D_D423V |
| phi29cc Stag-His6-Xa.N62D_I442V |
| phi29cc Stag-His6-Xa.N62D_Y449F |
| phi29cc Stag-His6-Xa.N62D_D456V |
| phi29cc Stag-His6-Xa.N62D_L480M |
| phi29cc Stag-His6-Xa.N62D_V509N |
| phi29cc Stag-His6-Xa.N62D_V509L |
| phi29cc Stag-His6-Xa.N62D_D510A |
| phi29cc Stag-His6-Xa.N62D_V514L |
| phi29cc Stag-His6-Xa.N62D_V514K |
| phi29cc Stag-His6-Xa.N62D_E515K |
| phi29cc Stag-His6-Xa.N62D_D523T |
| phi29cc Stag-His6-Xa.N62D_H149Y_E375W_M594S |
| phi29cc Stag-His6-Xa.N8S_N62D_M102S_H149Y_M188S_E375W |
| phi29cc Stag-His6-Xa.N62D_M97S_E375W |
| phi29cc Stag-His6-Xa.N8S_N62D_M97S_M102S_M188S_E375W_M594S |
| phi29cc M8A_N62D_M97A_M102A_M188A_E375W_M594A |
| phi29cc Stag-GST-His6-Xa.N62D_E375Y_K512Y |
| phi29cc Stag-GST-His6-Xa.N62D_E375Y_K512F |
| phi29cc Stag-GST-His6-Xa.N62D_E375Y_K512H |
| phi29cc Stag-GST-His6-Xa.N62D_S252A |
| phi29cc Stag-GST-His6-Xa.N62D_N387A |
| phi29cc Stag-GST-His6-Xa.N62D_K371Q |
| phi29cc Stag-GST-His6-Xa.N62D_I378K |
| phi29cc Stag-His6-Xa.N62D_S499C |
| phi29cc Stag-His6-Xa.N62D_Y390A |
| phi29cc Stag-His6-Xa.N62D_Y454P |
| phi29cc Stag-His6-Xa.N62D_K498R |
| phi29cc Stag-His6-Xa.N62D_L384G |
| phi29cc Stag-His6-Xa.N62D_L384A |
| phi29cc Stag-His6-Xa.N62D_L384I |
| phi29cc Stag-His6-Xa.N62D_L384V |
| phi29cc Stag-His6-Xa.N62D_L384M |
| phi29cc Stag-His6-Xa.N62D_L384K |

Fig. 34 (cont.)

| Description |
|---|
| phi29xo_Btag-His6-Xa_N62D_L384F |
| phi29xo_Btag-His6-Xa_N62D_L384W |
| phi29xo_Btag-His6-Xa_N62D_L384Y |
| phi29xo_Btag-His6-Xa_N62D_L384H |
| phi29xo_Btag-His6-Xa_N62D_L384Q |
| phi29xo_Btag-His6-Xa_N62D_L384T |
| phi29xo_Btag-His6-Xa_N62D_L384E |
| phi29xo_Btag-His6-Xa_N62D_L384P |
| phi29xo_Btag-His6-Xa_N62D_E375W_L384R |
| phi29xo_Btag-His6-Xa_N62D_L384R_E486A |
| phi29xo_Btag-His6-Xa_N62D_E375W_E486A |
| phi29xo_Btag-His6-Xa_N62D_E375W_L384R_E486A |
| phi29xo_Btag-His6-Xa_N62D_E486G |
| phi29xo_Btag-His6-Xa_N62D_E486A |
| phi29xo_Btag-His6-Xa_N62D_E486I |
| phi29xo_Btag-His6-Xa_N62D_E486V |
| phi29xo_Btag-His6-Xa_N62D_E486M |
| phi29xo_Btag-His6-Xa_N62D_E486K |
| phi29xo_Btag-His6-Xa_N62D_E486F |
| phi29xo_Btag-His6-Xa_N62D_E486W |
| phi29xo_Btag-His6-Xa_N62D_E486Y |
| phi29xo_Btag-His6-Xa_N62D_E486H |
| phi29xo_Btag-His6-Xa_N62D_E486Q |
| phi29xo_Btag-His6-Xa_N62D_E486T |
| phi29xo_Btag-His6-Xa_N62D |
| phi29xo_Btag-His6-Xa_N62D_E486P |
| phi29xo_Btag-His6-Xa_N62D_Y454E |
| phi29xo_Btag-His6-Xa_N62D_Y454G |
| phi29xo_Btag-His6-Xa_N62D_S459G |
| phi29xo_Btag-His6-Xa_N62D_K498E |
| phi29xo_Btag-His6-Xa_N62D_Y500Q |
| phi29xo_Btag-His6-Xa_N62D_Y500L |
| phi29xo_Btag-His6-Xa_N62D_L369F |
| phi29xo_Btag-His6-Xa_N62D_D362S |
| phi29xo_Btag-His6-Xa_N62D_F363W |
| phi29xo_Btag-His6-Xa_N62D_D365S |
| phi29xo_Btag-His6-Xa_N62D_L381K |
| phi29xo_Btag-His6-Xa_N62D_A382S |
| phi29xo_Btag-His6-Xa_N62D_N251K |
| phi29xo_Btag-His6-Xa_N62D_K478Y |
| phi29xo_Btag-His6-Xa_N62D_S252K |
| phi29xo_Btag-His6-Xa_N62D_A256K |
| phi29xo_Btag-His6-Xa_N62D_C448A |
| phi29xo_Btag-His6-Xa_C22A_N62D |
| phi29xo_Btag-His6-Xa_C22A_N62D_C448A |
| phi29xo_Btag-His6-Xa_N62D_M385A |
| phi29xo_Btag-His6-Xa_N62D_L381A |
| phi29xo_Btag-His6-Xa_N62D_L128A |

Fig. 34 (cont.)

| Description |
|---|
| phi29cs.Btag-His6-Xa.N62D_P127A. |
| phi29cs.Btag-GST-His6-Xa.D12A_N62D_E375Y_K512Y |
| phi29cs.Btag-GST-His6-Xa.D12A_N62D_K371Q |
| phi29cs.Btag-GST-His6-Xa.D12A_N62D_N387A |
| phi29cs.Btag-GST-His6-Xa.D12A_N62D_S252A |
| phi29cs.Btag-GST-His6-Xa.D12A_N62D_E375Y_K512F |
| phi29cs.Btag-GST-His6-Xa.D12A_N62D_L384G |
| phi29cs.Btag-GST-His6-Xa.D12A_N62D_L384Y |
| phi29cs.Btag-GST-His10-Xa.N62D_T368M |
| phi29cs.Btag-GST-His10-Xa.D12A_N62D_T368M |
| phi29cs.Btag-GST-His10-Xa.N62D_T368G |
| phi29cs.Btag-GST-His10-Xa.D12A_N62D_T368G |
| phi29cs.Btag-GST-His10-Xa.N62D_E486A |
| phi29cs.Btag-GST-His10-Xa.D12A_N62D_E486A |
| phi29cs.Btag-GST-His10-Xa.N62D_E486V |
| phi29cs.Btag-GST-His10-Xa.D12A_N62D_E486V |
| phi29cs.Btag-GST-His10-Xa.D12A_N62D_E375Y_K512Y |
| phi29cs.His10-Xa.N62D_E375Y_K512Y |
| phi29cs.His10-Xa.N62D |
| phi29cs.Btag-GST-His10-Xa.N62D |
| phi29cs.His10-Xa.D12A_N62D |
| phi29cs.Btag-GST-His10-Xa.D12A_N62D |
| phi29cs.His10-Xa.N62D_S252A_E375W |
| phi29cs.His10-Xa.N62D_T368G_E375W |
| phi29cs.His10-Xa.N62D_K371Q_E375W |
| phi29cs.His10-Xa.N62D_T373A_E375W |
| phi29cs.His10-Xa.N62D_E375W_K379T |
| phi29cs.His10-Xa.N62D_E375W_N387A |
| phi29cs.His10-Xa.N62D_E375W_V514K |
| phi29cs.His10-Xa.N62D_E375Y_K512F |
| phi29cs.His10-Xa.N62D_E375Y_K512H |
| phi29cs.His10-Xa.N62D_S252A_E375Y_K512Y |
| phi29cs.His10-Xa.N62D_T368G_E375Y_K512Y |
| phi29cs.His10-Xa.N62D_K371Q_E375Y_K512Y |
| phi29cs.His10-Xa.N62D_T373A_E375Y_K512Y |
| phi29cs.His10-Xa.N62D_E375Y_I378K_K512Y |
| phi29cs.His10-Xa.N62D_E375Y_K379T_K512Y |
| phi29cs.His10-Xa.N62D_E375Y_N387A_K512Y |
| phi29cs.His10-Xa.N62D_E375Y_K512Y_V514K |
| phi29cs.His10-Xa.N62D_S252A_N387A |
| phi29cs.His10-Xa.N62D_T368G_N387A |
| phi29cs.His10-Xa.N62D_K371Q_N387A |
| phi29cs.His10-Xa.N62D_T373A_N387A |
| phi29cs.His10-Xa.N62D_I378K_N387A |
| phi29cs.His10-Xa.N62D_K379T_N387A |
| phi29cs.His10-Xa.N62D_N387A_V514K |
| phi29cs.His10-Xa.N62D_S252A |
| phi29cs.His10-Xa.N62D_S252Y |

Fig. 34 (cont.)

| Description |
|---|
| phi29exo.His10-Xa.N62D_T368G |
| phi29exo.His10-Xa.N62D_T368L |
| phi29exo.His10-Xa.N62D_T368F |
| phi29exo.His10-Xa.N62D_K371Q |
| phi29exo.His10-Xa.N62D_K371R |
| phi29exo.His10-Xa.N62D_K371N |
| phi29exo.His10-Xa.N62D_K371H |
| phi29exo.His10-Xa.N62D_K371E |
| phi29exo.His10-Xa.N62D_T372K |
| phi29exo.His10-Xa.N62D_T373A |
| phi29exo.His10-Xa.N62D_T373S |
| phi29exo.His10-Xa.N62D_T373E |
| phi29exo.His10-Xa.N62D_T373Q |
| phi29exo.His10-Xa.N62D_T373K |
| phi29exo.His10-Xa.N62D_E375K |
| phi29exo.His10-Xa.N62D_I378K |
| phi29exo.His10-Xa.N62D_I378M |
| phi29exo.His10-Xa.N62D_I378A |
| phi29exo.His10-Xa.N62D_I378R |
| phi29exo.His10-Xa.N62D_I378D |
| phi29exo.His10-Xa.N62D_I378N |
| phi29exo.His10-Xa.N62D_I378H |
| phi29exo.His10-Xa.N62D_K379T |
| phi29exo.His10-Xa.N62D_K379L |
| phi29exo.His10-Xa.N62D_K379S |
| phi29exo.His10-Xa.N62D_N387G |
| phi29exo.His10-Xa.N62D_Y454A |
| phi29exo.His10-Xa.N62D_K512A |
| phi29exo.His10-Xa.N62D_V514K |
| phi29exo.His10-Xa.N62D_V514R |
| phi29exo.His10-Xa.N62D_V514S |
| phi29exo.His10-Xa.N62D_V514Q |
| phi29exo.His10-Xa.N62D_V514N |
| phi29exo.His10-Xa.N62D_V514H |
| phi29exo.Btag-GST-His10-Xa.D12A_N62D_T368G_E375W |
| phi29exo.Btag-GST-His10-Xa.D12A_N62D_E375Y_I378K_K512Y |
| phi29exo.Btag-GST-His10-Xa.D12A_N62D_E375Y_K379T_K512Y |
| phi29exo.Btag-GST-His10-Xa.D12A_N62D_E375Y_K512Y_V514K |
| phi29exo.Btag-GST-His10-Xa.D12A_N62D_T368F_E375Y_K512Y |
| phi29exo.Btag-GST-His10-Xa.D12A_N62D_E375Y_K379S_K512Y |
| phi29exo.Btag-GST-His10-Xa.D12A_N62D_T368G_E375Y_K512Y |
| phi29exo.Btag-GST-His10-Xa.D12A_N62D_T373A_E375Y_K512Y |
| phi29exo..N62D.His |
| phi29exo.Btag-GST-Xa.N62D.His |
| phi29exo.Btag-GST-His10-Xa.N62D_T368F_E375Y_K512Y |
| phi29exo.Btag-GST-His10-Xa.D12A_N62D_T373A_E375W |
| phi29exo.Btag-GST-His10-Xa.D12A_N62D_T368F |
| phi29exo.Btag-GST-His10-Xa.D12A_N62D_K379S |

Fig. 34 (cont.)

| Description |
|---|
| phi29co.His10-Xa.N62D_D458G. |
| phi29co.His10-Xa.N62D_E375Y_I378K. |
| phi29co.Stag-GST-His10-Xa.N62D_Y369V. |
| phi29co.Stag-GST-His10-Xa.N62D_M246L. |
| phi29co.Stag-GST-His10-Xa.N62D_Y505Y. |
| phi29co.Stag-GST-His10-Xa.N62D_Y369E. |
| phi29co.Stag-GST-His10-Xa.N62D_F246L. |
| phi29co.Stag-GST-His10-Xa.N62D_Y505V. |
| phi29co.Stag-GST-His10-Xa.N62D_W483V. |
| phi29co.Stag-GST-His10-Xa.N62D_H488G. |
| phi29co.Stag-GST-His10-Xa.N62D_Y521A. |
| phi29co.Stag-GST-His10-Xa.N62D_P526P. |
| phi29co.Stag-GST-His10-Xa.N62D_S252A_E375Y_K512Y. |
| phi29co.Stag-GST-His10-Xa.N62D_E375Y_I378K_K512Y. |
| phi29co.Stag-GST-His10-Xa.N62D_E375Y_I378T_K512Y. |
| phi29co.Stag-GST-His10-Xa.N62D_E375Y_K512Y_V514K. |
| phi29co.Stag-GST-His10-Xa.N62D_E375Y_I378S_K512Y. |
| phi29co.Stag-GST-His10-Xa.N62D_T368G_E375Y_K512Y. |
| phi29co.Stag-GST-His10-Xa.N62D_T373A_E375Y_K512Y. |
| phi29co.Stag-GST-His10-Xa.N62D_D458G. |
| phi29co.Stag-His10-Xa.N62D. |
| phi29co.Stag-His10-Xa.N62D_E375Y_K512Y. |
| phi29co.GST-His10-Xa.N62D. |
| phi29co.GST-His10-Xa.N62D_E375Y_K512Y. |
| phi29co.Stag-GST-His10-Xa.N62D_E375Y_K512Y. |
| phi29co.Stag-His10-Xa.N62D_T368F_E375Y_K512Y. |
| phi29co.Stag-His10-Xa.N62D_A68F_V514K. |
| phi29co.Stag-GST-His10-Xa.N62D_R138I_K371N. |
| phi29co.Stag-GST-His10-Xa.N62D_D423Y. |
| phi29co.Stag-GST-His10-Xa.N62D_G488M. |
| phi29co.Stag-GST-His10-Xa.T15I_N62D. |
| phi29co.Stag-His10-Xa.D12A_N62D_E375Y_K512Y. |
| phi29co.Stag-GST-His10-Xa.N62D_T368F_T373A. |
| phi29co.Stag-GST-His10-Xa.N62D_T368F_V514K. |
| phi29co.Stag-GST-His10-Xa.N62D_L253A. |
| phi29co.Stag-GST-His10-Xa.N62D_P153L_S388A. |
| phi29co.Stag-GST-His10-Xa.N62D_P153L. |
| phi29co.Stag-GST-His10-Xa.N62D_S388A. |
| phi29co.Stag-His10-Xa.N62D_E375Y_I378K_K512Y. |
| phi29co.Stag-His10-Xa.N62D_E375Y_K512Y_V514K. |
| phi29co.Stag-His10-Xa.N62D_T368G_E375Y_K512Y. |
| phi29co.Stag-His10-Xa.N62D_T373A_E375Y_K512Y. |
| phi29co.Stag-His10-Xa.T15I_N62D. |
| phi29co.His10-Xa.N62D_T368F_T373A. |
| phi29co.His10-Xa.N62D_T368F_I378K. |
| phi29co.His10-Xa.N62D_T368F_K373S. |
| phi29co.His10-Xa.N62D_T368F_K373T. |
| phi29co.His10-Xa.N62D_T368F_V514K. |

Fig. 34 (cont.)

| Description |
|---|
| phi29co.His10-Xa.N62D_T368G_T373A |
| phi29co.His10-Xa.N62D_T368G_I378K |
| phi29co.His10-Xa.N62D_T368G_K379S |
| phi29co.His10-Xa.N62D_T368G_K379T |
| phi29co.His10-Xa.N62D_T368G_Y514K |
| phi29co.His10-Xa.N62D_T373A_I378K |
| phi29co.His10-Xa.N62D_T373A_K379S |
| phi29co.His10-Xa.N62D_T373A_K379T |
| phi29co.His10-Xa.N62D_T373A_Y514K |
| phi29co.His10-Xa.N62D_I378K_K379S |
| phi29co.His10-Xa.N62D_I378K_K379T |
| phi29co.His10-Xa.N62D_I378K_Y514K |
| phi29co.His10-Xa.N62D_K379S_Y514K |
| phi29co.His10-Xa.N62D_K379T_Y514K |
| phi29co.His10-Xa.N62D_K379T_S517G |
| phi29co.His10-Xa.N62D_E375Y_K379S_K512Y |
| phi29co.His10-Xa.N62D_I93T |
| phi29co.His10-Xa.N62D_D138Y |
| phi29co.His10-Xa.N62D_S131A |
| phi29co.His10-Xa.N62D_Y226L |
| phi29co.His10-Xa.N62D_Y250L |
| phi29co.His10-Xa.N62D_L253A |
| phi29co.His10-Xa.N62D_L253A |
| phi29co.His10-Xa.N62D_Y254E |
| phi29co.His10-Xa.N62D_Y254L |
| phi29co.His10-Xa.N62D_Y254M |
| phi29co.His10-Xa.N62D_Y254T |
| phi29co.His10-Xa.N62D_T368A |
| phi29co.His10-Xa.N62D_T368D |
| phi29co.His10-Xa.N62D_T368E |
| phi29co.His10-Xa.N62D_T368K |
| phi29co.His10-Xa.N62D_T368N |
| phi29co.His10-Xa.N62D_T368P |
| phi29co.His10-Xa.N62D_T368S |
| phi29co.His10-Xa.N62D_T368V |
| phi29co.His10-Xa.N62D_T368Y |
| phi29co.His10-Xa.N62D_T373D |
| phi29co.His10-Xa.N62D_T373G |
| phi29co.His10-Xa.N62D_T373N |
| phi29co.His10-Xa.N62D_T373P |
| phi29co.His10-Xa.N62D_T373V |
| phi29co.His10-Xa.N62D_I378D |
| phi29co.His10-Xa.N62D_I378E |
| phi29co.His10-Xa.N62D_I378F |
| phi29co.His10-Xa.N62D_I378L |
| phi29co.His10-Xa.N62D_I378S |
| phi29co.His10-Xa.N62D_I378T |
| phi29co.His10-Xa.N62D_I378V |

Fig. 34 (cont.)

| Description |
|---|
| phi29cc.His10-Xa.N62D_K379A |
| phi29cc.His10-Xa.N62D_K379D |
| phi29cc.His10-Xa.N62D_K379H |
| phi29cc.His10-Xa.N62D_K379N |
| phi29cc.His10-Xa.N62D_K379P |
| phi29cc.His10-Xa.N62D_K379Q |
| phi29cc.His10-Xa.N62D_K379R |
| phi29cc.His10-Xa.N62D_K379V |
| phi29cc.His10-Xa.N62D_K383D |
| phi29cc.His10-Xa.N62D_P153L_S388A |
| phi29cc.His10-Xa.N62D_S388T |
| phi29cc.His10-Xa.N62D_Y390E |
| phi29cc.His10-Xa.N62D_Y390F |
| phi29cc.His10-Xa.N62D_G391T |
| phi29cc.His10-Xa.N62D_S395T |
| phi29cc.His10-Xa.N62D_Y399L |
| phi29cc.His10-Xa.N62D_K422R |
| phi29cc.His10-Xa.N62D_K478Y |
| phi29cc.His10-Xa.N62D_A484Y |
| phi29cc.His10-Xa.N62D_S188A |
| phi29cc.His10-Xa.N62D_M246L |
| phi29cc.His10-Xa.N62D_F246L |
| phi29cc.His10-Xa.N62D_F246R |
| phi29cc.His10-Xa.N62D_W367S |
| phi29cc.His10-Xa.N62D_W367R |
| phi29cc.His10-Xa.N62D_Y369V |
| phi29cc.His10-Xa.N62D_Y369E |
| phi29cc.His10-Xa.N62D_Y482V |
| phi29cc.His10-Xa.N62D_Y482K |
| phi29cc.His10-Xa.N62D_W483S |
| phi29cc.His10-Xa.N62D_W483V |
| phi29cc.His10-Xa.N62D_H485G |
| phi29cc.His10-Xa.N62D_Y505V |
| phi29cc.His10-Xa.N62D_Y505T |
| phi29cc.His10-Xa.N62D_M508L |
| phi29cc.His10-Xa.N62D_M508D |
| phi29cc.His10-Xa.N62D_Y521V |
| phi29cc.His10-Xa.N62D_Y521A |
| phi29cc.His10-Xa.N62D_F526L |
| phi29cc.His10-Xa.N62D_F526P |
| phi29cc.D12A_N62D_D66A |
| phi29cc.D12A_N62D_D66A_E375Y_K512Y |
| phi29cc.N62D |
| phi29cc.N62D_E375Y_K512Y |
| phi29cc.Bsg.His10-Xa.N62D_T368F_T373A |
| phi29cc.Bsg.His10-Xa.N62D_L253A |
| phi29cc.Bsg.His10-Xa.N62D_P153L_S388A |
| phi29cc.Bsg.His10-Xa.T15I_N62D_E375Y_K512Y |

Fig. 34 (cont.)

| Description |
|---|
| phi29co_Bsg_His10-Xa_T15I_N62D_T368F_E375Y_K512Y |
| phi29co_Bsg_His10-Xa_G12A_N62D_T368F_E375Y_K512Y |
| phi29co_Bsg_His10-Xa_N62D_T368F_E375Y_K512Y_V514K |
| phi29co_Bsg_His10-Xa_N62D_T368F_E375Y_I378K_K512Y |
| phi29co_Bsg_His10-Xa_N62D_T368F_E375Y_K379S_K512Y |
| phi29co_Bsg_His10-Xa_N62D_T368F_T373A_E375Y_K512Y |
| phi29co_Bsg_His10-Xa_N62D_T368F_E375Y_A377V_K512Y |
| phi29co_Bsg_His10-Xa_N62D_T368P_E375Y_K512Y |
| phi29co_Bsg_His10-Xa_N62D_T368P_V514K |
| phi29co_Bsg_His10-Xa_N62D_T368P_I378K |
| phi29co_Bsg_His10-Xa_N62D_T368P_K379S |
| phi29co_Bsg_His10-Xa_N62D_T368P_T373A |
| phi29co_Bsg_His10-Xa_N62D_T368P_A377V |
| phi29co_Bsg_His10-Xa_N62D_E375Y_A377V_K512Y |
| phi29co_Bsg_His10-Xa_N62D_A377V_V514K |
| phi29co_Bsg_His10-Xa_N62D_A377V_I378K |
| phi29co_Bsg_His10-Xa_N62D_A377V_K379S |
| phi29co_Bsg_His10-Xa_N62D_T373A_A377V |
| phi29co_Bsg_His10-Xa_N62D_A377V |
| phi29co_Bsg_His10-Xa_T17A_N62D |
| phi29co_Bsg_His10-Xa_Y24M_N62D |
| phi29co_Bsg_His10-Xa_A49R_N62D |
| phi29co_Bsg_His10-Xa_N62D_G70 |
| phi29co_Bsg_His10-Xa_N62D_V113L |
| phi29co_Bsg_His10-Xa_N62D_K124R |
| phi29co_Bsg_His10-Xa_N62D_K124L |
| phi29co_Bsg_His10-Xa_N62D_F128M |
| phi29co_Bsg_His10-Xa_N62D_F128Y |
| phi29co_Bsg_His10-Xa_N62D_K133G |
| phi29co_Bsg_His10-Xa_N62D_K133Q |
| phi29co_Bsg_His10-Xa_N62D_K143Q |
| phi29co_Bsg_His10-Xa_N62D_A176S |
| phi29co_Bsg_His10-Xa_N62D_G183S |
| phi29co_Bsg_His10-Xa_N62D_R236N |
| phi29co_Bsg_His10-Xa_N62D_P237Y |
| phi29co_Bsg_His10-Xa_N62D_V247I |
| phi29co_Bsg_His10-Xa_N62D_V247L |
| phi29co_Bsg_His10-Xa_N62D_Y259A |
| phi29co_Bsg_His10-Xa_N62D_Y259H |
| phi29co_Bsg_His10-Xa_N62D_H284F |
| phi29co_Bsg_His10-Xa_N62D_E291V |
| phi29co_Bsg_His10-Xa_N62D_K361N |
| phi29co_Bsg_His10-Xa_N62D_P363Y |
| phi29co_Bsg_His10-Xa_N62D_Y369H |
| phi29co_Bsg_His10-Xa_N62D_I370V |
| phi29co_Bsg_His10-Xa_N62D_K371R |
| phi29co_Bsg_His10-Xa_N62D_E375K |
| phi29co_Bsg_His10-Xa_N62D_G376N |

Fig. 34 (cont.)

| Description |
|---|
| phi29co_Btag-His10-Xa_N62D_G378S |
| phi29co_Btag-His10-Xa_N62D_A377G |
| phi29co_Btag-His10-Xa_N62D_A377S |
| phi29co_Btag-His10-Xa_N62D_K379R |
| phi29co_Btag-His10-Xa_N62D_L381I |
| phi29co_Btag-His10-Xa_N62D_L381M |
| phi29co_Btag-His10-Xa_N62D_S385T |
| phi29co_Btag-His10-Xa_N62D_W436F |
| phi29co_Btag-His10-Xa_N62D_W436Y |
| phi29co_Btag-His10-Xa_N62D_A445S |
| phi29co_Btag-His10-Xa_N62D_H461D |
| phi29co_Btag-His10-Xa_N62D_H461Y |
| phi29co_Btag-His10-Xa_N62D_L480I |
| phi29co_Btag-His10-Xa_N62D_L480M |
| phi29co_Btag-His10-Xa_N62D_K493E |
| phi29co_Btag-His10-Xa_N62D_I504V |
| phi29co_Btag-His10-Xa_N62D_K512R |
| phi29co_Btag-His10-Xa_N62D_T534M |
| phi29co_Btag-His10-Xa_N62D_R552Y |
| phi29co_Btag-His10-Xa_N62D_Y559I |
| phi29co_Btag-His10-Xa_A49R_N62D_D183S_E375Y_K379T_K512Y_V514Q |
| phi29co_Btag-His10-Xa_V24M_N62D_V118L_A178S_D183S_E375W |
| phi29co_Btag-His10-Xa_N62D_A256K_E375Y_I378N_K379S_K512Y |
| phi29co_Btag-His10-Xa_T17A_N62D_G78D_K361N_A377V_R552Y |
| phi29co_Btag-His10-Xa_N62D_Q183S_E375W_K379S_K493E_R552Y |
| phi29co_Btag-His10-Xa_N62D_A178S_T368F_E375Y_A377V_Y454A_K512Y |
| phi29co_Btag-His10-Xa_N62D_A256K |
| phi29co_Btag-His10-Xa_N62D_D362S |
| phi29co_Btag-His10-Xa_N62D_D365S |
| phi29co_Btag-His10-Xa_N62D_Y500Q |
| phi29_Btag-His10-Xa_N62D_T368F_E375Y_K512Y |
| phi29co_D12A_N62D_D66A_T368F_E375Y_K512Y |
| phi29co_Btag-His10-Xa_N62D_H384F_E291V_D365S_T368F_A445S |
| phi29co_Btag-His10-Xa_N62D_N387A_Y500Q_V514N_T534M_Y559I |
| phi29co_Btag-His10-Xa_N62D_D362S_T368G_I378H_Y454A_V514G |
| phi29co_Btag-His10-Xa_T17A_V24M_N62D_I378H_N387A |
| phi29co_Btag-His10-Xa_N62D_R236N_A256K_D365S_K379T_V514G |
| phi29co_Btag-His10-Xa_N62D_S052L |
| phi29co_Btag-His10-Xa_N62D_K371W |
| phi29co_Btag-His10-Xa_N62D_K371H |
| phi29co_Btag-His10-Xa_N62D_T368F_E375Y_Y505T_K512Y |
| phi29co_Btag-His10-Xa_N62D_T368F_E375Y_M506D_K512Y |
| phi29co_Btag-His10-Xa_N62D_T368F_E375Y_Y505T_M506D_K512Y |
| phi29co_Btag-His10-Xa_N62D_Y505T |
| phi29co_Btag-His10-Xa_N62D_M506D |
| phi29co_Btag-His10-Xa_N62D_Y505T_M506D |
| phi29co_Btag-His10-Xa_N62D_Q303K |
| phi29co_Btag-His10-Xa_N62D_Q303A |

Fig. 34 (cont.)

| Description |
|---|
| phi29co.Bag-His10-Xa.N62D_A53G |
| phi29co.Bag-His10-Xa.N62D_M63S |
| phi29co.Bag-His10-Xa.N62D_D535K |
| phi29co.Bag-His10-Xa.N62D_D535A |
| phi29co.Bag-His10-Xa.N62D_D570K |
| phi29co.Bag-His10-Xa.N62D_D570A |
| phi29co.Bag-His10-Xa.N62D_T571A |
| phi29co.Bag-His10-Xa.N62D_T573K |
| phi29co.Bag-His10-Xa.N62D_T573A |
| phi29co.Bag-His10-Xa.N62D_S252L_K371R |
| phi29co.Bag-His10-Xa.N62D_S252L_K371W |
| phi29co.Bag-His10-Xa.T17A_N62D_G78D_K143D_K361N_A377V_R562Y |
| phi29co.Bag-His10-Xa.N62D_K143D_L253A_T368F_E375Y_K512Y |
| phi29co.Bag-His10-Xa.N62D_F128M_K143D_L253A |
| phi29co.Bag-His10-Xa.N62D_F128M_I378K |
| phi29co.Bag-His10-Xa.N62D_Q183S_A256K_T368F |
| phi29co.Bag-His10-Xa.N62D_R236N_A256K_S395T |
| phi29co.Bag-His10-Xa.N62D_I378K_S395T_K512R |
| phi29co.Bag-His10-Xa.N62D_A256K_I378K_V514K |
| phi29co.Bag-His10-Xa.N62D_F128M_R236N_K512R |
| phi29co.Bag-His10-Xa.N62D_K143D_R236N_T368F |
| phi29co.Bag-His10-Xa.N62D_F128M_K143D_S395T |
| phi29co.Bag-His10-Xa.N62D_K143D_Q183S_V514K |
| phi29co.Bag-His10-Xa.N62D_Q183S_K512R_V514K |
| phi29co.Bag-His10-Xa.N62D_T368F_S395T_K512R |
| phi29co.Bag-His10-Xa.N62D_T368G_L489_V514Q |
| phi29co.Bag-His10-Xa.N62D_Y259A_E375K_R562Y |
| phi29co.Bag-His10-Xa.N62D_E291V_T368G_E375K_R562Y |
| phi29co.Bag-His10-Xa.N62D_K143G_G376N_W436Y |
| phi29co.Bag-His10-Xa.N62D_A256K_T373A_Y390Q |
| phi29co.Bag-His10-Xa.N62D_V247I_K379R_V514N |
| phi29co.Bag-His10-Xa.N62D_L480M_I514V_V559I |
| phi29co.Bag-His10-Xa.N62D_R236N_E375K_I378K |
| phi29co.Bag-His10-Xa.N62D_F128V_L381M_R562Y |
| phi29co.Bag-His10-Xa.N62D_F128M_L253A_W436Y |
| phi29co.Bag-His10-Xa.N62D_Q183S_F363Y_Y390Q |
| phi29co.Bag-His10-Xa.N62D_L253A_F363Y_L480M |
| phi29co.Bag-His10-Xa.N62D_G78D_F128M_R562Y |
| phi29co.Bag-His10-Xa.N62D_K379R_L489_V559I |
| phi29co.Bag-His10-Xa.N62D_F128V_K143D_G378N |
| phi29co.Bag-His10-Xa.T17A_N62D_L253A_T373A |
| phi29co.Bag-His10-Xa.N62D_Q183S_L480M_V514G |
| phi29co.Bag-His10-Xa.N62D_L253A_K371R_V514G |
| phi29co.Bag-His10-Xa.V54M_N62D_L253A_K379R |
| phi29co.Bag-His10-Xa.N62D_L253A_E291V_V514K |
| phi29co.Bag-His10-Xa.N62D_N313K |
| phi29co.Bag-His10-Xa.N62D_N313A |
| phi29co.Bag-His10-Xa.N62D_N368K |

Fig. 34 (cont.)

| Description |
|---|
| phi29co.Stag-His10-Xa.N62D_K529A |
| phi29co.Stag-His10-Xa.N62D_K529N |
| phi29co.Stag-His10-Xa.N62D_G533S |
| phi29co.Stag-His10-Xa.N62D_G533- |
| phi29co.Stag-His10-Xa.N62D_C530- |
| phi29co.Stag-His10-Xa.N62D_T534K |
| phi29co.Stag-His10-Xa.N62D_T534A |
| phi29co.Stag-His10-Xa.N62D_T571K |
| phi29co.Stag-His10-Xa.N62D_C530-_A531-_G532A_M533G |
| phi29co.Stag-His10-Xa.N62D_Q303K_T368F_E375Y_K512Y |
| phi29co.Stag-His10-Xa.N62D_Q303A_T368F_E375Y_K512Y |
| phi29co.Stag-His10-Xa.N62D_N313K_T368F_E375Y_K512Y |
| phi29co.Stag-His10-Xa.N62D_N313A_T368F_E375Y_K512Y |
| phi29co.Stag-His10-Xa.N62D_T368F_E375Y_N398K_K512Y |
| phi29co.Stag-His10-Xa.N62D_T368F_E375Y_K512Y_K529A |
| phi29co.Stag-His10-Xa.N62D_T368F_E375Y_K512Y_K529N |
| phi29co.Stag-His10-Xa.N62D_T368F_E375Y_K512Y_A531G |
| phi29co.Stag-His10-Xa.N62D_T368F_E375Y_K512Y_G532S |
| phi29co.Stag-His10-Xa.N62D_T368F_E375Y_K512Y_G532- |
| phi29co.Stag-His10-Xa.N62D_T368F_E375Y_K512Y_C530- |
| phi29co.Stag-His10-Xa.N62D_T368F_E375Y_K512Y_M533- |
| phi29co.Stag-His10-Xa.N62D_T368F_E375Y_K512Y_T534K |
| phi29co.Stag-His10-Xa.N62D_T368F_E375Y_K512Y_T534A |
| phi29co.Stag-His10-Xa.N62D_T368F_E375Y_K512Y_D535K |
| phi29co.Stag-His10-Xa.N62D_T368F_E375Y_K512Y_D535A |
| phi29co.Stag-His10-Xa.N62D_T368F_E375Y_K512Y_D570K |
| phi29co.Stag-His10-Xa.N62D_T368F_E375Y_K512Y_D570A |
| phi29co.Stag-His10-Xa.N62D_T368F_E375Y_K512Y_T571K |
| phi29co.Stag-His10-Xa.N62D_T368F_E375Y_K512Y_T571A |
| phi29co.Stag-His10-Xa.N62D_T368F_E375Y_K512Y_T573K |
| phi29co.Stag-His10-Xa.N62D_T368F_E375Y_K512Y_T573A |
| phi29co.Stag-His10-Xa.N62D_T368F_E375Y_K512Y_C530-_A531-_G532A_M533G |
| phi29co.Stag-His10-Xa.N62D_F128V_F363Y_I370V |
| phi29co.Stag-His10-Xa.N62D_T368F_G376N_S395T |
| phi29co.Stag-His10-Xa.N62D_A256K_H364F_Y509S |
| phi29co.Stag-His10-Xa.N62D_G78D_Y259A_L480M |
| phi29co.Stag-His10-Xa.N62D_E291V_F363Y_R552Y |
| phi29co.Stag-His10-Xa.N62D_E291V_L480I_I504V |
| phi29co.Stag-His10-Xa.N62D_H364F_G376N_L480I |
| phi29co.Stag-His10-Xa.N62D_F128M_T368F_I378K |
| phi29co.Stag-His10-Xa.N62D_H364F_L381M_I504V |
| phi29co.Stag-His10-Xa.N62D_F363Y_V514Q_Y559I |
| phi29co.Stag-His10-Xa.N62D_Y24P_G78K_V514G |
| phi29co.Stag-His10-Xa.N62D_Y24P_W436F_V514K |
| phi29co.Stag-His10-Xa.N62D_R236N_H364F_W436F |
| phi29co.Stag-His10-Xa.N62D_Y259A_V514K_Y559I |
| phi29co.Stag-His10-Xa.V64M_N62D_E291V_I370V |
| phi29co.Stag-His10-Xa.V64M_N62D_L381M_V514Q |

Fig. 34 (cont.)

| Description |
|---|
| phi29xo.Btag-His10-Xa_N62D_W436Y_Y500Q_V514K |
| phi29xo.Btag-His10-Xa_N62D_V247I_W436F_Y500Q |
| phi29xo.Btag-His10-Xa_N62D_I370V_G378K_V514G |
| phi29xo.Btag-His10-Xa_N62D_E291V_K361N_K371R |
| phi29xo.Btag-His10-Xa_V24M_N62D_V247I_I504V |
| phi29xo.Btag-His10-Xa_N62D_K361N_W436Y_I504V |
| phi29xo.Btag-His10-Xa_N62D_L381M_V514G_Y559I |
| phi29xo.Btag-His10-Xa_N62D_K361N_T368G_V514N |
| phi29xo.Btag-His10-Xa_N62D_Y259A_E375K_W436Y |
| phi29xo.Btag-His10-Xa_T17A_N62D_Y259A_E375K |
| phi29xo.Btag-His10-Xa_N62D_G78D_F128V_L381M |
| phi29xo.Btag-His10-Xa_N62D_K371R_K379R_V514N |
| phi29xo.Btag-His10-Xa_N62D_T373A_K379R_V514G |
| phi29xo.Btag-His10-Xa_N62D_G78D_K361N_K371R |
| phi29xo.Btag-His10-Xa_N62D_T368G_T373A_W436F |
| phi29xo.Btag-His10-Xa_N62D_I370V_K371R_V514N |
| phi29xo.Btag-His10-Xa_T17A_N62D_I370V_W436F |
| phi29xo.Btag-His10-Xa_T17A_N62D_T368G |
| phi29xo.Btag-His10-Xa_N62D_A259R_T368G_V514K |
| phi29xo.Btag-His10-Xa_N62D_Q183S_S395T_K512R |
| phi29xo.Btag-His10-Xa_T17A_N62D_F128V_K361N |
| phi29xo.Btag-His10-Xa_N62D_E291V_T373A_V514K |
| phi29xo.Btag-His10-Xa_N62D_E291V_T368G_R562Y |
| phi29xo.Btag-His10-Xa_V24M_N62D_G78D_L480I |
| phi29xo.Btag-His10-Xa_N62D_T368F_E375Y_G378D_K512Y |
| phi29xo.Btag-His10-Xa_N62D_T368F_E375Y_G378K_K512Y |
| phi29xo.Btag-His10-Xa_N62D_T368F_E375Y_G378N_M508D_K512Y |
| phi29xo.Btag-His10-Xa_N62D_T368F_E375Y_K512Y_C530S |
| phi29xo.Btag-His10-Xa_N62D_T368F |
| phi29xo.Btag-His10-Xa_N62D_H284F_T373A_K512R |
| phi29xo.Btag-His10-Xa_N62D_E375K_L480M_V514G |
| phi29xo.Btag-His10-Xa_N62D_T368F_E375Y_C455S_K512Y_C530S |
| phi29xo.Btag-His10-Xa_N62D_S307P_T368F_E375Y_K512Y |
| pET16.Btag.His10.Phi29_N62D_T368Y_E375Y_K512Y.co |
| pET16.Btag.His10.Phi29_N62D_I364D_T368Y_E375Y_K512Y.co |
| pET16.Btag.His10.Phi29_N62D_I364P_T368Y_E375Y_K512Y.co |
| pET16.Btag.His10.Phi29_N62D_I364D_T368V_E375Y_K512Y.co |
| pET16.Btag.His10.Phi29_N62D_I364P_T368Y_E375Y_K512Y.co |
| phi29xo.Btag-His10-Xa_N62D_I364_D368R_K368E_T368W_E375Y_K512Y |
| pET16.Btag.His10.Phi29_N62D_T368D_E375Y_K512Y.co |
| pET16.Btag.His10.Phi29_D458G.co |
| phi29xo.Btag-His10-Xa_N62D_T368F_E375Y_D510M_K512Y |
| phi29xo.Btag-His10-Xa_N62D_T368F_E375Y_G511M_K512Y |
| phi29xo.Btag-His10-Xa_N62D_T368F_E375Y_E508M_K512Y |
| phi29xo.Btag-His10-Xa_N62D_T368F_E375Y_K512Y_T522M |
| phi29xo.Btag-His10-Xa_N62D_T368F_E375Y_K512Y_D523M |
| phi29xo.Btag-His10-Xa_N62D_T368F_E375Y_K512Y_I524M |
| phi29xo.Btag-His10-Xa_N62D_L139M_T368F_E375Y_K512Y |

Fig. 34 (cont.)

| Description |
|---|
| phi29co.Btag.His10.Xa.N62D_L142M_T368F_E375Y_K512Y. |
| phi29co.Btag.His10.Xa.N62D_G144M_T368F_E375Y_K512Y. |
| phi29co.Btag.His10.Xa.N62D_Y148M_T368F_E375Y_K512Y. |
| phi29co.Btag.His10.Xa.N62D_H149M_T368F_E375Y_K512Y. |
| phi29co.Btag.His10.Xa.N62D_K150M_T368F_E375Y_K512Y. |
| phi29co.Btag.His10.Xa.N62D_T368F_E375Y_K512Y_G563C. |
| phi29co.Btag.His10.Xa.N62D_T368F_E375Y_K512Y_G564C. |
| phi29co.Btag.His10.Xa.N62D_D147C_E162C_T368F_E375Y_K512Y. |
| phi29co.Btag.His10.Xa.N62D_G87A_G191A_G197A_T368F_E375Y_G439A_K512Y. |
| phi29co.Btag.His10.Xa.Q28V_N62D_Q380V_T368F_E375Y_G413V_K512Y. |
| phi29co.Btag.His10.Xa.N62D_F360E_K361E_T368F_E375Y_K512Y. |
| phi29co.Btag.His10.Xa.N62D_T368F_E375Y_A377D_I378E_K512Y. |
| phi29co.Btag.His10.Xa.N62D_T368F_E375Y_Y426E_T427D_K512Y. |
| phi29co.Btag.His10.Xa.N62D_K309D_V310_T368F_E375Y_K512Y. |
| pET16.Btag.His10.Phi29.N62D_T368F_374.1Gins_E375Y_375.1Ains_K512Y.co |
| pET16.Btag.His10.Phi29.N62D_T368F_E375Y_511.1Gins_K512Y_512.1Gins.co |
| phi29co.Btag.His10.Xa.N62D_K309A_T368F_E375Y_K512Y. |
| phi29co.Btag.His10.Xa.N62D_K308A_T368F_E375Y_K512Y. |
| phi29co.Btag.His10.Xa.N62D_K205A_T368F_E375Y_K512Y. |
| phi29co.Btag.His10.Xa.N62D_K205A_K208A_K209A_T368F_E375Y_K512Y. |
| phi29co.Btag.His10.Xa.N62D_T368F_T372F_E375Y_K512Y. |
| phi29co.Btag.His10.Xa.N62D_T368F_T372Y_E375Y_K512Y. |
| phi29co.Btag.His10.Xa.N62D_T368F_T372N_E375Y_K512Y. |
| phi29co.Btag.His10.Xa.N62D_T368F_T372Q_E375Y_K512Y. |
| phi29co.Btag.His10.Xa.N62D_T368F_T372L_E375Y_K512Y. |
| phi29co.Btag.His10.Xa.S43D_N62D_T368F_E375Y_K512Y. |
| phi29co.Btag.His10.Xa.N62D_T159D_T368F_E375Y_K512Y. |
| phi29co.Btag.His10.Xa.N62D_S215D_T368F_E375Y_K512Y. |
| pET16.Btagco.His10co.Phi29.N62D_374.1G_E375Y_375.1G_K512Y.co |
| phi29co.Btag.His10.Xa.N62D_S352L_T368F_K371W_E375Y_K512Y. |
| phi29co.Btag.His10.Xa.N62D_S352L_T368F_K371H_E375Y_K512Y. |
| phi29co.Btagco.His10co.Xaco.N62D_T368F_E375Y_K512Y. |
| pET16.Btag.His10.Phi29.N62D_T368F_E375Y_G378N_K512Y.co |
| pET16.Btag.His10.Phi29.N62D_T368F_E375Y_M506D_K512Y_L513D.co |
| pET16.Btag.His10.Phi29.N62D_T368F_E375Y_M506D_K512Y_L513K.co |
| pET16.Btag.His10.Phi29.N62D_T368F_E375Y_M506D_K512Y_L513N.co |
| pET16.Btag.His10.N62D_T368F_E375Y_Y500Q_F508P_Y531A_L253A_K512Y.co |
| phi29co.Btag.His10.Xa.N62D_T368F_E375Y_K512Y_P526P. |
| phi29co.Btag.His10.Xa.N62D_T368F_E375Y_Y500Q_K512Y. |
| phi29co.Btag.His10.Xa.N62D_T368F_E375Y_K512Y_Y531A. |
| phi29co.Btag.His10.Xa.N62D_P526P. |
| phi29co.Btag.His10.Xa.N62D_Y531A. |
| pET16.Btag.His10.N62D_Y500Q.co |
| phi29co.Btag.His10.Xa.N62D_V154P. |
| phi29co.Btag.His10.Xa.N62D_E162C. |
| phi29co.Btag.His10.Xa.N62D_D166G. |
| phi29co.Btag.His10.Xa.N62D_L183P. |
| phi29co.Btag.His10.Xa.N62D_L253I. |

Fig. 34 (cont.)

| Description |
|---|
| phi29co.8tag-His10-Xa.N62D_I637Y. |
| phi29co.8tag-His10-Xa.D46R_N62D |
| phi29co.8tag-His10-Xa.N62D_W73R |
| phi29co.8tag-His10-Xa.N62D_I70G |
| phi29co.8tag-His10-Xa.N62D_V154L |
| phi29co.8tag-His10-Xa.N62D_I158L |
| phi29co.8tag-His10-Xa.N62D_E162Y |
| phi29co.8tag-His10-Xa.N62D_I637A |
| phi29co.8tag-His10-Xa.N62D_Y566M |
| phi29co.8tag-His10-Xa.N62D_L567M |
| phi29co.8tag-His10-Xa.N62D_V568M |
| phi29co.8tag-His10-Xa.D46R_N62D |
| phi29co.8tag-His10-Xa.N62D_R78K |
| phi29co.8tag-His10-Xa.N62D_W73R |
| phi29co.8tag-His10-Xa.N62D_I70S |
| phi29co.8tag-His10-Xa.N62D_G98S |
| phi29co.8tag-His10-Xa.N62D_I158P |
| phi29co.8tag-His10-Xa.N62D_Y163C |
| phi29co.8tag-His10-Xa.N62D_L177P |
| phi29co.8tag-His10-Xa.N62D_L178P |
| phi29co.8tag-His10-Xa.N62D_Y566L |
| phi29co.8tag-His10-Xa.N62D_L567I |
| phi29co.8tag-His10-Xa.N62D_V568L |
| phi29co.8tag-His10-Xa.N62D_M633I |
| phi29co.8tag-His10-Xa.C22S_N62D_C106S_T368F_E375Y_C455S_K512Y_Y521A_C530S. |
| phi29co.8tag-His10-Xa.C11S_C22S_N62D_C106S_T368F_E375Y_C455S_K512Y_C530S. |
| phi29co.8tag-His10-Xa.C11S_C22S_N62D_C106S_T368F_E375Y_C455S_K512Y_Y521A_C530S. |
| phi29co.8tag-His10-Xa.C11S_C22S_N62D_C106S_C290S_T368F_E375Y_C448A_C455S_K512Y_Y521A_C530S. |
| phi29co.8tag-His10-Xa.N62D_T368F_E375Y_K512Y_V514Y. |
| phi29co.8tag-His10-Xa.N62D_T368F_E375Y_K512Y_V514F. |
| phi29co.8tag-His10-Xa.N62D_T368F_E375Y_K478Y_K512Y. |
| phi29co.8tag-His10-Xa.N62D_T368F_T372L_E375Y_K478Y_K512Y. |
| phi29co.8tag-His10-Xa.N62D_T368F_T372Y_E375Y_K478Y_K512Y. |
| phi29co.8tag-His10-Xa.N62D_T368F_T372Y_E375Y_K478L_K512Y. |
| phi29co.8tag-His10-Xa.N62D_T368F_E375Y_A377Y_S395T_K512Y. |
| phi29co.8tag-His10-Xa.N62D_T368F_E375Y_L480K_K512Y. |
| phi29co.8tag-His10-Xa.N62D_T368F_E375W_K512I. |
| phi29co.8tag-His10-Xa.N62D_T368F_E375W_K512M. |
| phi29co.8tag-His10-Xa.N62D_D135A_T368F_E375Y_A377I_K512Y. |
| phi29co.8tag-His10-Xa.N62D_D135G_T368F_E375Y_A377E_K512Y. |
| phi29co.8tag-His10-Xa.N62D_T368F_E375Y_Y505L_M508T_K512Y. |
| phi29co.8tag-His10-Xa.N62D_T368F_E375Y_Y505L_M508I_K512Y_Y521L. |
| phi29co.8tag-His10-Xa.N62D_T368F_E375Y_Y505V_M508L_K512Y_Y521L. |
| phi29co.8tag-His10-Xa.N62D_T368F_E375Y_Y505V_M508L_K512Y. |
| phi29co.8tag-His10-Xa.N62D_T368F_E375Y_Y505V_M508T_K512Y_Y521S. |
| phi29co.8tag-His10-Xa.N62D_T368F_E375Y_Y505T_M508P_K512Y. |
| phi29co.8tag-His10-Xa.N62D_T368F_E375Y_Y505K_M508P_K512Y_Y521T. |
| phi29co.8tag-His10-Xa.N62D_D135A_T368Y_E375Y_A377I_K512Y. |

Fig. 34 (cont.)

| Description |
|---|
| phi29cc_Bag-His10-Xa_N62D_D138A_T368F_E375Y_A377I_Y388L_M506T_K512Y |
| phi29cc_Bag-His10-Xa_N62D_T368Y_E379W_L480K_Y388L_M506T_K512M |
| phi29cc_Bag-His10-Xa_N62D_D249E_T368F_E375Y_K512Y |
| phi29cc_Bag-His10-Xa_N62D_T368F_E375Y_A484E_K512Y |
| phi29cc_Bag-His10-Xa_N62D_D249E_T368F_E375Y_A484E_K512Y |
| phi29cc_Bag-His10-Xa_N62D_T368F_E375Y_L381A_K512Y |
| phi29cc_Bag-His10-Xa_N62D_I179A_T368F_E375Y_K512Y |
| phi29cc_Bag-His10-Xa_N62D_T368F_E375Y_I378A_K512Y |
| phi29cc_Bag-His10-Xa_N62D_I179A_T368F_E375Y_I378A_L381A_K512Y |
| phi29cc_Bag-His10-Xa_N62D_T368F_I378A_E375Y_I378A_K512Y |
| phi29cc_Bag-His10-Xa_N62D_I179A_T368F_I378A_E375Y_I378A_L381A_K512Y |
| phi29cc_Bag-His10-Xa_N62D_T368F_E375Y_A484D_K512Y |
| phi29cc_Bag-His10-Xa_N62D_T368F_E375Y_A484H_K512Y |
| phi29cc_Bag-His10-Xa_N62D_T368F_E375Y_A484Y_K512Y |
| phi29cc_Bag-His10-Xa_N62D_D249E_T368F_E375Y_A484H_K512Y |
| phi29cc_Bag-His10-Xa_N62D_D249E_T368F_E375Y_A484Y_K512Y |
| phi29cc_Bag-His10-Xa_N62D_T368F_E375Y_K383L_K512Y |
| phi29cc_Bag-His10-Xa_N62D_T368F_E375Y_K383H_K512Y |
| phi29cc_Bag-His10-Xa_N62D_T368F_E375Y_K383R_K512Y |
| phi29cc_Bag-His10-Xa_N62D_T368F_E375Y_Q380R_K512Y |
| phi29cc_Bag-His10-Xa_N62D_T368F_E375Y_Q380H_K512Y |
| phi29cc_Bag-His10-Xa_N62D_T368F_E375Y_Q380K_K512Y |
| phi29cc_Bag-His10-Xa_N62D_T368F_K371L_E375Y_K512Y |
| phi29cc_Bag-His10-Xa_N62D_T368F_K371H_E375Y_K512Y |
| phi29cc_Bag-His10-Xa_N62D_T368F_K371R_E375Y_K512Y |
| phi29cc_Bag-His10-Xa_N62D_T368F_E375Y_K373L_K512Y |
| phi29cc_Bag-His10-Xa_N62D_T368F_E375Y_K373H_K512Y |
| phi29cc_Bag-His10-Xa_N62D_T368F_E375Y_K373R_K512Y |
| phi29cc_Bag-His10-Xa_N62D_T368F_E375Y_E486D_K512Y |
| phi29cc_Bag-His10-Xa_N62D_T368F_E375Y_E486A_K512Y |
| phi29cc_Bag-His10-Xa_N62D_T368F_T373H_E375Y_K512Y |
| phi29cc_Bag-His10-Xa_N62D_T368F_T372V_E375Y_K512Y |
| phi29cc_Bag-His10-Xa_N62D_T368F_T372I_E375Y_K512Y |
| phi29cc_Bag-His10-Xa_N62D_T368F_E375Y_L480H_K512Y |
| phi29cc_Bag-His10-Xa_N62D_T368F_E375Y_L480F_K512Y |
| phi29cc_Bag-His10-Xa_N62D_D365N_T368F_E375Y_K512Y |
| phi29cc_Bag-His10-Xa_N62D_L253A_T368F_E375Y_K512Y |
| phi29cc_Bag-His10-Xa_N62D_I179W_T368F_E375Y_K512Y |
| phi29cc_Bag-His10-Xa_N62D_I179H_T368F_E375Y_K512Y |
| phi29cc_Bag-His10-Xa_N62D_F211A_T368F_E375Y_K512Y |
| phi29cc_Bag-His10-Xa_N62D_F211W_T368F_E375Y_K512Y |
| phi29cc_Bag-His10-Xa_N62D_F211H_T368F_E375Y_K512Y |
| phi29cc_Bag-His10-Xa_N62D_F198A_T368F_E375Y_K512Y |
| phi29cc_Bag-His10-Xa_N62D_F198W_T368F_E375Y_K512Y |
| phi29cc_Bag-His10-Xa_N62D_F198H_T368F_E375Y_K512Y |
| phi29cc_Bag-His10-Xa_N62D_P255A_T368F_E375Y_K512Y |
| phi29cc_Bag-His10-Xa_N62D_P255W_T368F_E375Y_K512Y |
| phi29cc_Bag-His10-Xa_N62D_P255H_T368F_E375Y_K512Y |

| Description |
|---|
| phi29cc Bsago-His10co-Xaco.T368F_E375Y_A484E_K512Y. |
| phi29cc Bsago-His10co-Xaco.T368F_E375Y_K379R_A484E_K512Y. |
| phi29cc Bsago-His10co-Xaco.T368F_E375Y_K379K_K512Y. |
| phi29cc Bsago-His10co-Xaco.N62D_T368F_E375Y_A484K_K512Y. |
| phi29cc Bsago-His10co-Xaco.N62D_T368F_E375Y_A484R_K512Y. |
| phi29cc Bsago-His10co-Xaco.Y101K_T368F_E375Y_K512Y. |
| phi29cc Bsago-His10co-Xaco.M188K_T368F_E375Y_K512Y. |
| phi29cc Bsago-His10co-Xaco.T189K_T368F_E375Y_K512Y. |
| phi29cc Bsago-His10co-Xaco.Q303K_T368F_E375Y_K512Y. |
| phi29cc Bsago-His10co-Xaco.N313K_T368F_E375Y_K512Y. |
| phi29cc Bsago-His10co-Xaco.T368F_E375Y_S385K_K512Y. |
| phi29cc Bsago-His10co-Xaco.T368F_E375Y_P414K_K512Y. |
| phi29cc Bsago-His10co-Xaco.T368F_E375Y_Q467K_K512Y. |
| phi29cc Bsago-His10co-Xaco.T368F_E375Y_Y500K_K512Y. |
| phi29cc Bsago-His10co-Xaco.T368F_E375Y_K512Y_A531K. |
| phi29cc Bsago-His10co-Xaco.T368F_E375Y_K512Y_G532K. |
| phi29cc Bsago-His10co-Xaco.T368F_E375Y_K512Y_T534K. |
| phi29cc Bsago-His10co-Xaco.T368F_E375Y_K512Y_P558K. |
| phi29cc Bsago-His10co-Xaco.T368F_E375Y_K512Y_D573K. |
| phi29cc Bsago-His10co-Xaco.T368F_E375Y_K512Y_I574K. |
| phi29cc Bsago-His10co-Xaco.T368F_E375Y_K512Y_F575K. |
| phi29cc Bsago-His10co-Xaco.T368F_E375Y_S465D_A484E_K512Y. |
| phi29cc Bsago-His10co-Xaco.T368F_E375Y_S465E_A484E_K512Y. |
| phi29cc Bsago-His10co-Xaco.T368F_E375Y_A484E_S487D_K512Y. |
| phi29cc Bsago-His10co-Xaco.T368F_E375Y_A484E_S487E_K512Y. |
| phi29cc Bsago-His10co-Xaco.T368F_E375Y_P477D_K512Y. |
| phi29cc Bsago-His10co-Xaco.T368F_E375Y_P477E_K512Y. |
| phi29cc Bsago-His10co-Xaco.C11V_C22V_C106S_C290V_T368F_E375Y_C448V_C455S_K512Y_C535S. |
| phi29cc Bsago-His10co-Xaco.C22V_C106S_C290V_T368F_E375Y_C448V_C455S_K512Y_C535S. |
| phi29cc Bsago-His10co-Xaco.C11V_C106S_C290V_T368F_E375Y_C448V_C455S_K512Y_C535S. |
| phi29cc Bsago-His10co-Xaco.C11V_C106S_C290V_T368F_E375Y_C455S_K512Y_C535S. |
| phi29cc Bsago-His10co-Xaco.N251R_T368F_E375Y_K512Y. |
| phi29cc Bsago-His10co-Xaco.N251D_T368F_E375Y_K512Y. |
| phi29cc Bsago-His10co-Xaco.T368F_E375Y_N387H_K512Y. |
| phi29cc Bsago-His10co-Xaco.T368F_T372Q_E375Y_A484E_K512Y. |
| phi29cc Bsago-His10co-Xaco.T368F_T372Q_E375Y_A484Y_K512Y. |
| phi29cc Bsago-His10co-Xaco.T368F_T372L_E375Y_A484E_K512Y. |
| phi29cc Bsago-His10co-Xaco.T368F_T372L_E375Y_A484Y_K512Y. |
| phi29cc Bsago-His10co-Xaco.T368F_T372Y_E375Y_K478Y_A484E_K512Y. |
| phi29cc Bsago-His10co-Xaco.T368F_T372L_E375Y_K478Y_A484Y_K512Y. |
| phi29cc Bsago-His10co-Xaco.T368F_E375Y_A484R_K512Y. |
| phi29cc Bsago-His10co-Xaco.N62D_T368F_E375Y_N387L_A484E_K512Y. |
| phi29cc Bsago-His10co-Xaco.N62D_T368F_E375Y_N387L_A484Y_K512Y. |
| phi29cc Bsago-His10co-Xaco.N62D_T368F_T372Q_E375Y_N387L_A484E_K512Y. |
| phi29cc Bsago-His10co-Xaco.N62D_T368F_T372Q_E375Y_N387L_A484Y_K512Y. |
| phi29cc Bsago-His10co-Xaco.N62D_T368F_T372L_E375Y_N387L_A484E_K512Y. |
| phi29cc Bsago-His10co-Xaco.N62D_T368F_T372L_E375Y_N387L_K478Y_A484Y_K512Y. |
| phi29cc Bsago-His10co-Xaco.N62D_T368F_T372L_E375Y_N387L_K478Y_A484E_K512Y. |

| Description |
|---|
| phi29co_Btagpo-His10co-Xaco_N62D_T368F_E375Y_G391A_K512Y. |
| phi29co_Btagpo-His10co-Xaco_N62D_T368F_E375Y_G391V_K512Y. |
| phi29co_Btagpo-His10co-Xaco_N62D_T368F_E375Y_G391T_K512Y. |
| phi29co_Btagpo-His10co-Xaco_N62D_T368F_E375Y_G391L_K512Y. |
| phi29co_Btagpo-His10co-Xaco_N62D_T368F_E375Y_G391M_K512Y. |
| phi29co_Btagpo-His10co-Xaco_N62D_T368F_E375Y_Y390V_K512Y. |
| phi29co_Btagpo-His10co-Xaco_N62D_T368F_E375Y_Y390A_K512Y. |
| phi29co_Btagpo-His10co-Xaco_N62D_T368F_E375Y_Y390F_K512Y. |
| phi29co_Btagpo-His10co-Xaco_N62D_T368F_E375Y_Q380D_K512Y. |
| phi29co_Btagpo-His10co-Xaco_N62D_T368F_E375Y_K512Y. |
| phi29co_Btagpo-His10co-Xaco_N62D_T368F_E375Y_D458L_K512Y. |
| phi29co_Btagpo-His10co-Xaco_N62D_T368F_E375Y_T457Q_K512Y. |
| phi29co_Btagpo-His10co-Xaco_N62D_T368F_E375Y_T457L_K512Y. |
| phi29co_Btagpo-His10co-Xaco_N62D_T368F_E375Y_D456Y_K512Y. |
| pET16_Btagpo-His10co-Phi29_N62D_T368F_E375Y_K512Y_co_Bs-Aco |
| phi29co_Btagpo-His10co-Xaco_K84A_T368F_E375Y_K512Y. |
| phi29co_Btagpo-His10co-Xaco_K305A_T368F_E375Y_K512Y. |
| phi29co_Btagpo-His10co-Xaco_T368F_E375Y_K393A_K512Y. |
| phi29co_Btagpo-His10co-Xaco_T368F_E375Y_K402A_K512Y. |
| phi29co_Btagpo-His10co-Xaco_T368F_E375Y_K422A_K512Y. |
| phi29co_Btagpo-His10co-Xaco_T368F_E375Y_R496A_K512Y. |
| phi29co_Btagpo-His10co-Xaco_T368F_E375Y_K512Y_K529A. |
| phi29co_Btagpo-His10co-Xaco_T368F_E375Y_K512Y_K538A. |
| phi29co_Btagpo-His10co-Xaco_T368F_E375Y_K512Y_K555A. |
| phi29co_Btagpo-His10co-Xaco_T368F_E375Y_N387L_A484E_K512Y. |
| phi29co_Btagpo-His10co-Xaco_N62D_T368F_E375Y_Y390V_W436Y_Y505V_M508L_K512Y. |
| phi29co_Btagpo-His10co-Xaco_N62D_E76*_T368F_E375Y_I378G_K512Y. |
| phi29co_Btagpo-His10co-Xaco_N62D_T368F_E375Y_I378P_K512Y. |
| phi29co_Btagpo-His10co-Xaco_N62D_T368F_E375Y_I378E_K512Y. |
| phi29co_Btagpo-His10co-Xaco_N62D_P300A_Y315L_T368F_E375Y_K512Y. |
| phi29co_Btagpo-His10co-Xaco_N62D_P300S_Y315L_T368F_E375Y_K512Y. |
| phi29co_Btagpo-His10co-Xaco_N62D_P300E_Y315N_T368F_E375Y_K512Y. |
| phi29co_Btagpo-His10co-Xaco_N62D_P300E_Y315L_T368F_E375Y_K512Y. |
| phi29co_Btagpo-His10co-Xaco_N62D_P300G_Y315V_T368F_E375Y_K512Y. |
| phi29co_Btagpo-His10co-Xaco_N62D_T368F_E375Y_K512Y_L567R. |
| phi29co_Btagpo-His10co-Xaco_N62D_T368F_E375Y_I378G_K512Y. |
| phi29co_Btagpo-His10co-Xaco_N62D_F137R_T368F_E375Y_I378L_K512Y. |
| phi29co_Btagpo-His10co-Xaco_N62D_T368F_E375Y_W483V_H485K_K512Y. |
| phi29co_Btagpo-His10co-Xaco_N62D_Q183S_S252I_L253A_Y364A_T368F_K371H_E375Y_Y390V_W436Y_M508L_K512Y. |
| phi29co_Btagpo-His10co-Xaco_N62D_F129M_T368F_E375Y_Y390V_W436Y_Y505V_M508L_K512Y. |
| phi29co_Btagpo-His10co-Xaco_N62D_P300A_Y315R_T368F_E375Y_K512Y. |
| phi29co_Btagpo-His10co-Xaco_N62D_P300N_Y315K_T368F_E375Y_K512Y. |
| phi29co_Btagpo-His10co-Xaco_N62D_F137P_T368F_E375Y_I378K_K512Y. |
| phi29co_Btagpo-His10co-Xaco_N62D_T368F_E375Y_W483A_H485P_K512Y. |
| phi29co_Btagpo-His10co-Xaco_N62D_N251K_T368F_E375Y_K512Y. |
| phi29co_Btagpo-His10co-Xaco_N62D_N251Q_T368F_E375Y_K512Y. |
| phi29co_Btagpo-His10co-Xaco_N62D_N251D_T368F_E375Y_K512Y. |
| phi29co_Btagpo-His10co-Xaco_N62D_P255K_T368F_E375Y_K512Y. |

Fig. 34 (cont.)

| Description |
|---|
| phi29co.Bagco-His10co-Xaco.N62D_N251Q_P255K_T368F_E375Y_K512Y |
| phi29co.Bagco-His10co-Xaco.N62D_N251R_P255K_T368F_E375Y_K512Y |
| phi29co.Bagco-His10co-Xaco.N62D_T368F_E375Y_P477K_K512Y |
| phi29co.Bagco-His10co-Xaco.N62D_T368F_E375Y_P477Q_K512Y |
| phi29co.Bagco-His10co-Xaco.N62D_T368F_E375Y_P477D_K512Y |
| phi29co.Bagco-His10co-Xaco.N62D_T368F_T372G_E375Y_A484E_K512Y |
| phi29co.Bagco-His10co-Xaco.N62D_T368F_T372G_E375Y_A484Y_K512Y |
| phi29co.Bagco-His10co-Xaco.N62D_T368F_T372L_E375Y_A484E_K512Y |
| phi29co.Bagco-His10co-Xaco.N62D_T368F_T372L_E375Y_A484Y_K512Y |
| phi29co.Bagco-His10co-Xaco.N62D_T368F_T372Y_E375Y_K478Y_A484E_K512Y |
| phi29co.Bagco-His10co-Xaco.N62D_T368F_T372L_E375Y_K478Y_A484Y_K512Y |
| pET16.Bagco.His10co.Phi29.N62D_T368F_E375Y_K512Y_E515K.co |
| pET16.Bagco.His10co.Phi29.N62D_T368F_E375Y_K512Y_E515R.co |
| pET16.Bagco.His10co.Phi29.N62D_T368F_E375Y_E486K_K512Y.co |
| pET16.Bagco.His10co.Phi29.N62D_T368F_E375Y_E486R_K512Y.co |
| pET16.Bagco.His10co.Phi29.N62D_T368F_E375Y_A484K_E486K_K512Y.co |
| pET16.Bagco.His10co.Phi29.N62D_T368F_E375Y_A484R_E486R_K512Y.co |
| pET16.Bagco.His10co.Phi29.N62D_T368F_E375Y_A484R_E486R_K512Y_E515R.co |
| pET16.Bagco.His10co.Phi29.N62D_T368F_E375Y_A484K_E486K_K512Y_E515K.co |
| phi29co.Bagco-His10co-Xaco.N62D_E375Y_A484E_K512Y |
| pET16.Bagco.His10co.Phi29.N62D_E375Y_I378K_A484E_K512Y.co |
| pET16.Bagco.His10co.Phi29.N62D_T368G_E375Y_A484E_K512Y.co |
| pET16.Bagco.His10co.Phi29.T151_T368F_E375Y_N387R_A484E_K512Y.co |
| pET16.Bagco.His10co.Phi29.T151_T368F_E375Y_A484E_K512Y.co |
| pET16.Bagco.His10co.Phi29.K313K_T368F_E375Y_Q497K_K512Y.co |
| pET16.Bagco.His10co.Phi29.N62D_N313K_T368F_E375Y_A484E_Q497K_K512Y.co |
| phi29co.Bagco-His10co-Xaco.N62H_L185K_E508R_D523K |
| pET16.Bagco.His10co.Phi29.T368F_E375Y_E508R_K512Y_D523R.co |
| pET16.Bagco.His10co.Phi29.L185D_T368F_E375Y_E508V_K512Y_D523R.co |
| pET16.Bagco.His10co.Phi29.L185K_T368F_E375Y_E508V_K512Y_D523L.co |
| pET16.Bagco.His10co.Phi29.N62D_P300E_Y315L_T368F_E375Y_A484E_K512Y.co |
| pET16.Bagco.His10co.Phi29.N62G_P300G_Y315V_T368F_E375Y_A484E_K512Y.co |
| pET16.Bagco.His10co.Phi29.T368F_E375Y_E508R_K512Y.co |
| pET16.Bagco.His10co.Phi29.T368F_E375Y_K512Y_D523R.co |
| pET16.Bagco.His10co.Phi29.L185D_T368F_E375Y_K512Y.co |
| pET16.Bagco.His10co.Phi29.L185K_T368F_E375Y_K512Y.co |
| pET16.Bagco.His10co.Phi29.T368F_E375Y_K512Y_D523L.co |
| phi29co.Bagco-His10co-Xaco.N62H_T368F_E375Y_N387L_A484E_K512Y |
| pET16.Bagco.His10co.Phi29.N62H_T368F_E375Y_A484E_K512Y.co |
| pET16.Bagco.His10co.Phi29.N62H_T368F_E375Y_K512Y.co |
| phi29co.Bagco-Xaco.N62D_T368F_E375Y_A484E_K512Y |
| pET16.Bagco.His10co.M188K_T368F_E375Y_Q497K_K512Y.co |
| pET16.Bagco.His10co.T368F_E375Y_S395K_Q497K_K512Y.co |
| pET16.Bagco.His10co.T368F_E375Y_Q497K_K512Y_T534K.co |
| pET16.Bagco.His10co.M188K_T368F_E375Y_S395K_Q497K_K512Y_T534K.co |
| pET16.Bagco.His10co.N62D_T368F_E375Y_Q497K_K512Y.co |
| pET16.Bagco.His10co.N62D_M188K_T368F_E375Y_Q497K_K512Y.co |
| pET16.Bagco.His10co.N62D_T368F_E375Y_S395K_Q497K_K512Y.co |

Fig. 34 (cont.)

| Description |
|---|
| pET16.Btagco.His10co.N62D_T368F_E375Y_Q497K_K512Y_T534K.co |
| pET16.Btagco.His10co.N62D_M188K_T368F_E375Y_S395K_Q497K_K512Y_T534K.co |
| pET16.Btagco.His10co.Q303K_T368F_E375Y_Q497K_K512Y.co |
| pET16.Btagco.His10co.N313K_T368F_E375Y_Q497K_K512Y.co |
| pET16.Btagco.His10co.T368F_E375Y_Q

| Description |
|---|
| phi29co_Stago-His10co-Xaco.A178E_T368F_E375Y_K512Y |
| phi29co_Stago-His10co-Xaco.A178T_T368F_E375Y_K512Y |
| phi29co_Stago-His10co-Xaco.A178V_T368F_E375Y_K512Y |
| phi29co_Stago-His10co-Xaco.Q180L_T368F_E375Y_K512Y |
| phi29co_Stago-His10co-Xaco.F181P_T368F_E375Y_K512Y |
| phi29co_Stago-His10co-Xaco.K182P_T368F_E375Y_K512Y |
| phi29co_Stago-His10co-Xaco.Q183D_T368F_E375Y_K512Y |
| phi29co_Stago-His10co-Xaco.Q183K_T368F_E375Y_K512Y |
| phi29co_Stago-His10co-Xaco.L185D_T368F_E375Y_K512Y |
| phi29co_Stago-His10co-Xaco.L185K_T368F_E375Y_K512Y |
| phi29co_Stago-His10co-Xaco.A190E_T368F_E375Y_K512Y |
| phi29co_Stago-His10co-Xaco.A190F_T368F_E375Y_K512Y |
| phi29co_Stago-His10co-Xaco.A190L_T368F_E375Y_K512Y |
| phi29co_Stago-His10co-Xaco.A190P_T368F_E375Y_K512Y |
| phi29co_Stago-His10co-Xaco.A190T_T368F_E375Y_K512Y |
| phi29co_Stago-His10co-Xaco.A190V_T368F_E375Y_K512Y |
| phi29co_Stago-His10co-Xaco.G191A_T368F_E375Y_K512Y |
| phi29co_Stago-His10co-Xaco.G191P_T368F_E375Y_K512Y |
| phi29co_Stago-His10co-Xaco.L253E_T368F_E375Y_K512Y |
| phi29co_Stago-His10co-Xaco.K361P_T368F_E375Y_K512Y |
| phi29co_Stago-His10co-Xaco.D365E_T368F_E375Y_K512Y |
| phi29co_Stago-His10co-Xaco.D365P_T368F_E375Y_K512Y |
| phi29co_Stago-His10co-Xaco.T368F_E375Y_L381F_K512Y |
| phi29co_Stago-His10co-Xaco.T368F_E375Y_L381K_K512Y |
| phi29co_Stago-His10co-Xaco.T368F_E375Y_L381R_K512Y |
| phi29co_Stago-His10co-Xaco.T368F_E375Y_S388A_K512Y |
| phi29co_Stago-His10co-Xaco.T368F_E375Y_E508R_K512Y |
| phi29co_Stago-His10co-Xaco.T368F_E375Y_E508V_K512Y |
| phi29co_Stago-His10co-Xaco.T368F_E375Y_K512Y_D523F |
| phi29co_Stago-His10co-Xaco.T368F_E375Y_K512Y_D523L |
| phi29co_Stago-His10co-Xaco.T368F_E375Y_K512Y_D523R |
| phi29co_Stago-His10co-Xaco.N62D_I170F_E375Y_K512Y |
| phi29co_Stago-His10co-Xaco.N62D_I170R_E375Y_K512Y |
| phi29co_Stago-His10co-Xaco.N62D_A178E_E375Y_K512Y |
| phi29co_Stago-His10co-Xaco.N62D_A178T_E375Y_K512Y |
| phi29co_Stago-His10co-Xaco.N62D_A178V_E375Y_K512Y |
| phi29co_Stago-His10co-Xaco.N62D_Q180L_E375Y_K512Y |
| phi29co_Stago-His10co-Xaco.N62D_F181P_E375Y_K512Y |
| phi29co_Stago-His10co-Xaco.N62D_K182P_E375Y_K512Y |
| phi29co_Stago-His10co-Xaco.N62D_Q183D_E375Y_K512Y |
| phi29co_Stago-His10co-Xaco.N62D_Q183K_E375Y_K512Y |
| phi29co_Stago-His10co-Xaco.N62D_L185D_E375Y_K512Y |
| phi29co_Stago-His10co-Xaco.N62D_L185K_E375Y_K512Y |
| phi29co_Stago-His10co-Xaco.N62D_A190E_E375Y_K512Y |
| phi29co_Stago-His10co-Xaco.N62D_A190F_E375Y_K512Y |
| phi29co_Stago-His10co-Xaco.N62D_A190L_E375Y_K512Y |
| phi29co_Stago-His10co-Xaco.N62D_A190P_E375Y_K512Y |
| phi29co_Stago-His10co-Xaco.N62D_A190T_E375Y_K512Y |

Fig. 34 (cont.)

| Description |
|---|
| phi29co_Btagco-His10co-Xaco_N62D_A190V_E375Y_K512Y. |
| phi29co_Btagco-His10co-Xaco_N62D_G191A_E375Y_K512Y. |
| phi29co_Btagco-His10co-Xaco_N62D_G191P_E375Y_K512Y. |
| phi29co_Btagco-His10co-Xaco_N62D_L253E_E375Y_K512Y. |
| phi29co_Btagco-His10co-Xaco_N62D_K361P_E375Y_K512Y. |
| phi29co_Btagco-His10co-Xaco_N62D_D365E_E375Y_K512Y. |
| phi29co_Btagco-His10co-Xaco_N62D_D365P_E375Y_K512Y. |
| phi29co_Btagco-His10co-Xaco_N62D_E375Y_L381F_K512Y. |
| phi29co_Btagco-His10co-Xaco_N62D_E375Y_L381K_K512Y. |
| phi29co_Btagco-His10co-Xaco_N62D_E375Y_L381R_K512Y. |
| phi29co_Btagco-His10co-Xaco_N62D_E375Y_S388A_K512Y. |
| phi29co_Btagco-His10co-Xaco_N62D_E375Y_E508R_K512Y. |
| phi29co_Btagco-His10co-Xaco_N62D_E375Y_E508V_K512Y. |
| phi29co_Btagco-His10co-Xaco_N62D_E375Y_K512Y_D523F. |
| phi29co_Btagco-His10co-Xaco_N62D_E375Y_K512Y_D523L. |

| Description |
|---|
| phi29co_Btagco-His10co-Xaco.N62D_E375Y_A484E_K512Y_D523R |
| phi29co_Btagco-His10co-Xaco.N62D_I178P |
| phi29co_Btagco-His10co-Xaco.N62D_I178R |
| phi29co_Btagco-His10co-Xaco.N62D_A178E |
| phi29co_Btagco-His10co-Xaco.N62D_A178T |
| phi29co_Btagco-His10co-Xaco.N62D_A178V |
| phi29co_Btagco-His10co-Xaco.N62D_G180L |
| phi29co_Btagco-His10co-Xaco.N62D_F181P |
| phi29co_Btagco-His10co-Xaco.N62D_K182P |
| phi29co_Btagco-His10co-Xaco.N62D_Q183D |
| phi29co_Btagco-His10co-Xaco.N62D_Q183K |
| phi29co_Btagco-His10co-Xaco.N62D_L185G |
| phi29co_Btagco-His10co-Xaco.N62D_L185K |
| phi29co_Btagco-His10co-Xaco.N62D_A190E |
| phi29co_Btagco-His10co-Xaco.N62D_A190F |
| phi29co_Btagco-His10co-Xaco.N62D_A190L |
| phi29co_Btagco-His10co-Xaco.N62D_A190P |
| phi29co_Btagco-His10co-Xaco.N62D_A190T |
| phi29co_Btagco-His10co-Xaco.N62D_A190V |
| phi29co_Btagco-His10co-Xaco.N62D_G191A |
| phi29co_Btagco-His10co-Xaco.N62D_G191P |
| phi29co_Btagco-His10co-Xaco.N62D_L253E |
| phi29co_Btagco-His10co-Xaco.N62D_K361P |
| phi29co_Btagco-His10co-Xaco.N62D_D365E |
| phi29co_Btagco-His10co-Xaco.N62D_D365P |
| phi29co_Btagco-His10co-Xaco.N62D_L381F |
| phi29co_Btagco-His10co-Xaco.N62D_L381K |
| phi29co_Btagco-His10co-Xaco.N62D_L381R |
| phi29co_Btagco-His10co-Xaco.N62D_S398A |
| phi29co_Btagco-His10co-Xaco.N62D_E508R |
| phi29co_Btagco-His10co-Xaco.N62D_E508V |
| phi29co_Btagco-His10co-Xaco.N62D_D523F |
| phi29co_Btagco-His10co-Xaco.N62D_D523L |
| phi29co_Btagco-His10co-Xaco.N62D_D523R |
| pET16.Btagco.His10co.Phi29.N62D_E375Y_A484E_Q497K_K512Y.co |
| pET16.Btagco.His10co.Phi29.N62D_E375Y_A484K_Q497K_K512Y.co |
| pET16.Btagco.His10co.Phi29.N62D_T368P_E375Y_L384M_Q497K_K512Y.co |
| pET16.Btagco.His10co.Phi29.N62D_T368P_E375Y_E420R_A484E_K512Y.co |
| pET16.Btagco.His10co.Phi29.N62D_T368P_E375Y_E420M_A484E_K512Y.co |
| pET16.Btagco.His10co.Phi29.N62D_T368P_E375Y_E420R_K512Y.co |
| pET16.Btagco.His10co.Phi29.N62D_T368P_E375Y_E420M_K512Y.co |
| pET16.Btagco.His10co.Phi29.N62D_E375Y_L384M_A484E_K512Y.co |
| pET16.Btagco.His10co.Phi29.N62D_E375Y_E420R_A484E_K512Y.co |
| pET16.Btagco.His10co.Phi29.N62D_E375Y_E420M_A484E_K512Y.co |
| pET16.Btagco.His10co.Phi29.N62D_E375Y_E420R_K512Y.co |
| pET16.Btagco.His10co.Phi29.N62D_E375Y_E420M_K512Y.co |
| pET16.Btagco.His10co.Phi29.N62D_E375Y_P477E_A484E_K512Y.co |
| pET16.Btagco.His10co.Phi29.N62D_E375Y_P477K_A484E_K512Y.co |

Fig. 34 (cont.)

| Description |
|---|
| pET16.Btagcc.His10co.Phi29.N62D_E375Y_P477Q_A484E_K512Y.co |
| pET16.Btagcc.His10co.Phi29.N62D_N251Q_E375Y_A484E_K512Y.co |
| pET16.Btagcc.His10co.Phi29.N62D_E375Y_Q497K_K512Y_K575A.co |
| pET16.Btagcc.His10co.Phi29.N62D_E375Y_A484E_Q497K_K512Y_K575A.co |
| pET16.Btagcc.His10co.Phi29.N62D_E375Y_L381E_A484E_K512Y.co |
| pET16.Btagcc.His10co.Phi29.N62D_E375Y_N387M_A484E_K512Y.co |
| pET16.Btagcc.His10co.Phi29.N62D_E375Y_L381E_N387M_A484E_K512Y.co |
| pET16.Btagcc.His10co.Phi29.N62D_E375Y_L384R_A484E_K512Y.co |
| pET16.Btagcc.His10co.Phi29.N62D_E375Y_L384R_N387M_A484E_K512Y.co |
| pET16.Btagcc.His10co.Phi29.N62D_E375Y_A484E_K512Y_K575A.co |
| pET16.Btagcc.His10co.Phi29.N62D_E375Y_A484E_K512Y_K555A.co |
| pET16.Btagcc.His10co.Phi29.N62D_E375Y_K392A_A484E_K512Y.co |
| pET16.Btagcc.His10co.Phi29.N62D_E375Y_V399Y_A484E_Q497K_K512Y_K575A.co |
| pET16.Btagcc.His10co.Phi29.N62D_I93Y_E375Y_A484E_Q497K_K512Y_K575A.co |
| pET16.Btagcc.His10co.Phi29.N62D_E375Y_S385K_A484E_Q497K_K512Y_K575A.co |
| pET16.Btagcc.His10co.Phi29.N62D_T368F_E375Y_P477E_A484E_K512Y.co |
| pET16.Btagcc.His10co.Phi29.N62D_T368F_E375Y_P477Q_A484E_K512Y.co |
| pET16.Btagcc.His10co.Phi29.N62D_N251Q_T368F_E375Y_A484E_K512Y.co |
| pET16.Btagcc.His10co.Phi29.N62D_T368F_E375Y_Q497K_K512Y_K575A.co |
| pET16.Btagcc.His10co.Phi29.N62D_T368F_E375Y_A484E_Q497K_K512Y_K575A.co |
| pET16.Btagcc.His10co.Phi29.N62D_T368F_E375Y_L381E_A484E_K512Y.co |
| pET16.Btagcc.His10co.Phi29.N62D_T368F_E375Y_N387M_A484E_K512Y.co |
| pET16.Btagcc.His10co.Phi29.N62D_T368F_E375Y_L381E_N387M_A484E_K512Y.co |
| pET16.Btagcc.His10co.Phi29.N62D_T368F_E375Y_L384R_A484E_K512Y.co |
| pET16.Btagcc.His10co.Phi29.N62D_T368F_E375Y_A484E_K512Y_K575A.co |
| pET16.Btagcc.His10co.Phi29.N62D_T368F_E375Y_A484E_K512Y_K555A.co |
| pET16.Btagcc.His10co.Phi29.N62D_T368F_E375Y_K392A_A484E_K512Y.co |
| pET16.Btagcc.His10co.Phi29.N62D_T368F_E375Y_V399Y_A484E_Q497K_K512Y_K575A.co |
| pET16.Btagcc.His10co.Phi29.N62D_I93Y_T368F_E375Y_A484E_Q497K_K512Y_K575A.co |
| pET16.Btagcc.His10co.Phi29.N62D_T368F_E375Y_S385K_A484E_K512Y_K575A.co |
| phi29co.Btagcc-His10co-Xaco.T368F_E375Y_K392R_K512Y |
| phi29co.Btagcc-His10co-Xaco.T368F_E375Y_K422R_K512Y |
| phi29co.Btagcc-His10co-Xaco.T368F_E375Y_K392M_K512Y |
| phi29co.Btagcc-His10co-Xaco.T368F_E375Y_K392W_K512Y |
| phi29co.Btagcc-His10co-Xaco.T368F_E375Y_K422M_K512Y |
| phi29co.Btagcc-His10co-Xaco.T368F_E375Y_K422W_K512Y |
| pET16.Btagcc.His10co.Phi29.L33_1K_G11.T368F_E375Y_K392R_A484E_K512Y.co |
| pET16.Btagcc.His10co.Phi29.L33_06_H11.T368F_E375Y_K422R_A484E_K512Y.co |
| pET16.Btagcc.His10co.Phi29.L33_14_G02.T368F_E375Y_K392M_A484E_K512Y.co |
| pET16.Btagcc.His10co.Phi29.L33_14_G08.T368F_E375Y_K392W_A484E_K512Y.co |
| pET16.Btagcc.His10co.Phi29.L33_14_H08.T368F_E375Y_K422M_A484E_K512Y.co |
| pET16.Btagcc.His10co.Phi29.L33_14_H08.T368F_E375Y_K422W_A484E_K512Y.co |
| pET16.Btagcc.His10.Phi29.N62D_G235D_T368F_T372Q_E375Y_I378W_A484E_K512Y.co |
| pET16.Btagcc.His10co.Phi29.D66K_T368F_E375Y_A484E_K512Y.co |
| pET16.Btagcc.His10co.Phi29.D66R_T368F_E375Y_A484E_K512Y.co |
| pET16.Btagcc.His10co.Phi29.D66M_T368F_E375Y_A484E_K512Y.co |
| pET16.His10.Phi29.D13A_D66A_T368F_E375Y_P477D_K512Y.co |
| pET16.His10.Phi29.D13A_D66A_T368F_E375Y_P477D_A484E_K512Y.co |

| Description |
|---|
| pET16.Btsgcc.His10cc.CTerm_His10.Phi29.D12R_T368F_I378W_A484E_E508R_511.1K_511.2S_512.1G_512.2S.co |
| pET16.Btsgcc.His10cc.CTerm_His10.Phi29.D12R_T368F_A484E_E508R_511.1K_511.2S_512.1G_512.2S.co |
| pET16.Btsgcc.His10cc.Phi29.N62D_E375Y_Q380K_N387L_P477D_A484E_Q497K_E508R_K512Y.co |
| pET16.Btsgcc.His10cc.Phi29.N62D_T372Q_E375Y_Q380K_N387L_S395K_P477D_A484E_Q497K_E508R_K512Y.co |
| pET16.Btsgcc.His10cc.Phi29.N62D_I364G_T368G_E375Y_K512Y.co |
| pET16.Btsgcc.His10cc.Phi29.N62D_M188H_T368F_E375Y_A484E_K512Y.co |
| pET16.Btsgcc.His10cc.CTerm_His10.Phi29.I93Y_T368F_T372Q_E375Y_I378W_K479Y_A484E_E508R_511.1K_511.2S_K512Y_512.1G_512.2S.co |
| pET16.Btsgcc.His10cc.CTerm_His10.Phi29.T368F_E375Y_A484E_K512Y.co |
| pET16.Btsgcc.His10cc.CTerm_His10.Phi29.D12R_T368F_E375Y_A484E_E508R_D510M_511.1K_511.2S_512.1G_512.2S_D523M.co |
| pET16.Btsgcc.His10cc.CTerm_His10.Phi29.D12R_T368F_E375Y_A484E_E508R_D510R_511.1K_511.2S_512.1G_512.2S.co |
| pET16.Btsgcc.His10cc.Phi29.N62D_M97R_T368F_E375Y_A484E_K512Y.co |
| pET16.Btsgcc.His10cc.Phi29.N62D_96.1R_M97R_97.1R_T368F_E375Y_A484E_K512Y.co |
| pET16.Btsgcc.His10cc.Phi29.N62D_Q85C_N96C_M97R_Y193C_T368F_E375Y_A484E_K512Y.co |
| pET16.Btsgcc.His10cc.Phi29.E14A_D145A_D169A_T368F_E375Y_A484E_K512Y.co |
| pET16.Btsgcc.His10cc.Phi29.N62D_M102K_T368F_E375Y_A484E_K512Y.co |
| pET16.Btsgcc.His10cc.Phi29.N62D_M102R_T368F_E375Y_A484E_K512Y.co |
| pET16.Btsgcc.His10cc.Phi29.N62D_Y226R_T368F_E375Y_A484E_K512Y.co |
| pET16.Btsgcc.His10cc.Phi29.N62D_Y226F_T368F_E375Y_A484E_K512Y.co |
| pET16.Btsgcc.His10cc.Phi29.N62D_Y226C_T368F_E375Y_A484E_K512Y.co |
| pET16.Btsgcc.His10cc.Phi29.N62D_Y101K_T368F_E375Y_A484E_K512Y.co |
| pET16.Btsgcc.His10cc.Phi29.N62D_Y101V_T368F_E375Y_A484E_K512Y.co |
| pET16.Btsgcc.His10cc.Phi29.N62D_Y101E_T368F_E375Y_A484E_K512Y.co |
| pET16.Btsgcc.His10cc.Phi29.N62D_M188E_T368F_E375Y_A484E_K512Y.co |
| pET16.Btsgcc.His10cc.Phi29.N62D_M188N_T368F_E375Y_A484E_K512Y.co |
| pET16.Btsgcc.His10cc.Phi29.N62D_T189R_T368F_E375Y_A484E_K512Y.co |
| pET16.Btsgcc.His10cc.Phi29.N62D_Y101H_M102H_M188H_T189H_T368F_E375Y_A484E_K512Y.co |
| pET16.Btsgcc.His10cc.CTerm_His10.Phi29.D12R_T368F_T372Q_E375Y_A484E_E508R_511.1K_511.2S_512.1G_512.2S.co |
| pET16.Btsgcc.His10cc.CTerm_His10.Phi29.D12R_T368F_T372Q_E375Y_A484E_E508R_D510M_511.1K_511.2S_512.1G_512.2S_D523M.co |
| pET16.Btsgcc.His10cc.CTerm_His10.Phi29.N62D_H149M_T368F_E375Y_D510M_K512Y_D523M.co |
| pET16.Btsgcc.His10cc.CTerm_His10.Phi29.N62D_H149M_T368F_E375Y_A484E_D510M_K512Y_D523M.co |
| pET16.Btsgcc.His10cc.Phi29.N62D_H149M_L253A_E375Y_D510M_K512Y_D523M.co |
| pET16.Btsgcc.His10cc.Phi29.N62D_H149M_L253A_E375Y_D510M_K512Y_D523M.co |
| pET16.Btsgcc.His10cc.Phi29.N62D_T368F_E375Y_K512Y.co.PCR_ext |
| pET16.Btsgcc.His10cc.Phi29.N62D_T368F_E375Y_A484E_K512Y.co.PCR_ext |
| pET16.Btsgcc.Cterm_His10.Phi29.N62D_T368F_E375Y_A484E_K512Y.co |
| pET16.Btsgcc.CTerm_His10.Phi29.D12R_N62H_T368F_E375Y_A484E_K512Y.co |
| pET16.Btsgcc.CTerm_His10.Phi29.D12R_T368F_E375Y_A484E_E508R_511.1K_511.2S_512.1G_512.2S.co |
| pET16.Btsgcc.His10cc.Cterm_His10.Phi29.N62D_T368F_E375Y_K422A_A484E_K512Y.co |
| pET16.Btsgcc.His10cc.Phi29.N62D_Y226R_T368F_E375Y_A484E_K512Y.co |
| pET16.Btsgcc.His10cc.CTerm_His10.Phi29.D12R_T368F_E375Y_A484E_E508R_D510R_511.1K_511.2S_512.1G_512.2S_D523R.co |
| pET16.Btsgcc.His10cc.Phi29.D249M_D458M.co |
| pET16.Btsgcc.His10cc.Phi29.N62D_D249M_D458M.co |
| pET16.Btsgcc.His10cc.Cterm_His10.Phi29.N62D_D249M_T368F_E375Y_D458M_A484E_K512Y.co |
| pET16.Btsgcc.His10cc.Phi29.co |
| pET16.Btsgcc.His10cc.D12R_E375Y_A484E_K512Y.co |
| pET16.Btsgcc.His10cc.D12M_E375Y_A484E_K512Y.co |
| pET16.Btsgcc.His10cc.Cterm_His10.Phi29.N62D_L253A_E375Y_A484E_K512Y.co |

| Description |
|---|
| pET16.Btagco.His10co.Phi29.D66M_Y148A_T368F_E375Y_R496V_K512Y.co |
| pET16.Btagco.His10co.Phi29.D66M_Y148A_T368F_E375Y_R496F_K512Y.co |
| pET16.Btagco.His10co.Phi29.D66M_Y148A_Q303G_T368F_E375Y_K512Y.co |
| pET16.Btagco.His10co.Phi29.D66M_Y148A_T368F_E375Y_Q497Y_K512Y.co |
| pET16.Btagco.His10co.Phi29.D66M_Y148A_T368F_E375Y_R496M_K512Y.co |
| pET16.Btagco.His10co.Phi29.D66M_L185K_L253A_E375Y_A484E_E508V_K512Y_D523L.co |
| pET16.Btagco.His10co.Phi29.D66M_L185D_L253A_E375Y_A484E_E508V_K512Y_D523F.co |
| pET16.Btagco.His10co.Phi29.D66M_L253A_T368Y_E375Y_A484Q_K512Y.co |
| pET16.Btagco.His10co.Phi29.D66M_Y148A_L253A_E375Y_K392T_A484E_K512Y.co |
| pET16.Btagco.His10co.Phi29.D66M_Y148A_L253A_E375Y_A484E_Q497Y_K512Y.co |
| pET16.Btagco.His10co.ClemHis10.Phi29.L253A_E375Y_K392T_A484E_K512Y.co |
| pET16.Btagco.His10co.ClemHis10.Phi29.L253A_E375Y_A484E_Q497Y_K512Y.co |
| pET16.Btagco.His10co.Phi29.D66M_L253A_W357L_E375Y_A484E_K512Y.co |
| pET16.Btagco.His10co.Phi29.D66M_L253A_E375Y_W483L_A484E_K512Y.co |
| pET16.Btagco.His10co.Phi29.N62D_L253A_E375Y_A484E_K512Y.co |
| pET16.Btagco.His10co.Phi29.N62D_L253A_E375Y_P477Q_A484E_K512Y.co |
| pET16.Btagco.His10co.Phi29.N62D_L253A_E375Y_P477E_K512Y.co |
| pET16.Btagco.His10co.Phi29.N62D_I83Y_L253A_T368F_E375Y_A484E_K512Y.co |
| pET16.Btagco.His10co.Phi29.N62D_L253A_T368F_E375Y_A484E_Q497K_K512Y.co |
| pET16.Btagco.His10co.Phi29.N62D_L253A_T368F_E375Y_K402A_A484E_K512Y.co |
| pET16.Btagco.His10co.Phi29.N62D_L253A_T368F_E375Y_L384R_A484E_K512Y.co |
| pET16.Btagco.His10co.Phi29.N62D_L253A_E375Y_A484E_E508R_K512Y.co |
| pET16.Btagco.His10co.Clem_His10.Phi29.N62D_L253A_E375Y_P477Q_A484Q_K512Y.co |
| pET16.Btagco.His10co.Phi29.N62D_L253A_E375Y_N387L_P477Q_A484Q_K512Y.co |
| pET16.Btagco.His10co.Clem_His10.Phi29.N62D_L253A_E375Y_A484E_K512Y_P518K.co |
| pET16.Btagco.His10co.Clem_His10.Phi29.N62D_L253A_E375Y_A484E_K512Y_P518R.co |
| pET16.Btagco.His10co.Clem_His10.Phi29.N62D_L253A_E375Y_A484E_K512Y_P518K_D519K.co |
| pET16.Btagco.His10co.Clem_His10.Phi29.N62D_L253A_E375Y_A484E_K512Y_P518R_D519K.co |
| pET16.Btagco.His10co.N62D_Y254A_E375Y_A484E_K512Y.co |
| pET16.Btagco.His10co.N62D_L253A_Y254A_E375Y_A484E_K512Y.co |
| pET16.Btagco.His10co.N62D_L253S_E375Y_A484E_K512Y.co |
| pET16.Btagco.His10co.N62D_L253S_Y254A_E375Y_A484E_K512Y.co |
| pET16.Btagco.His10co.N62D_L253S_Y254A_P255V_E375Y_A484E_K512Y.co |
| pET16.Btagco.His10co.N62D_L253W_E375Y_A484E_K512Y.co |
| pET16.Btagco.His10co.N62D_Y254L_E375Y_A484E_K512Y.co |
| pET16.Btagco.His10co.N62D_P255V_E375Y_A484E_K512Y.co |
| pET16.Btagco.His10co.N62D_L253A_P255V_E375Y_A484E_K512Y.co |
| pET16.Btagco.His10co.N62D_L253A_Y254A_P255V_E375Y_A484E_K512Y.co |
| pET16.Btagco.His10co.N62D_L253W_I364A_D365S_E375Y_K379V_K383A_A484E_K512Y.co |
| pET16.Btagco.His10co.N62D_L253A_Y254A_P255S_E375Y_A484E_K512Y.co |
| pET16.Btagco.His10co.N62D_L253A_I364A_D365S_E375Y_K379V_K383A_A484E_K512Y.co |
| pET16.Btagco.His10co.N62D_L253A_E375Y_K383W_A484E_K512Y.co |
| pET16.Btagco.His10co.N62D_L253A_E375Y_K379V_K383A_A484E_K512Y.co |
| pET16.Btagco.His10co.Phi29.N62D_T368F_E375Y_C455G_A484E_K512Y.co |
| pET16.Btagco.His10co.Phi29.N62D_T368F_E375Y_C455G_K512Y.co |
| pET16.Btagco.His10co.Phi29.N62D_E375Y_C455G_A484E_K512Y.co |
| pET16.Btagco.His10co.Phi29.N62D_L253A_E375Y_C455G_A484E_K512Y.co |
| pET16.Btagco.His10co.Phi29.N62D_L253A_E375Y_P477E_A484E_K512Y.co |

Fig. 34 (cont.)

| Description |
|---|
| pET16.Btagcc.His10cc.Phi29.N62D_L253A_E375Y_A484E_Q497K_K512Y.co |
| pET16.Btagcc.His10cc.Phi29.N62D_I93Y_L253A_E375Y_A484E_K512Y.co |
| pET16.Btagcc.His10cc.Phi29.N62D_I93F_L253A_E375Y_A484E_K512Y.co |
| pET16.Btagcc.His10cc.Phi29.N62D_L253A_E375Y_K402A_A484E_K512Y.co |
| pET16.Btagcc.His10cc.Phi29.N62D_L253A_E375Y_Q380K_A484E_K512Y.co |
| pET16.Btagcc.His10cc.Phi29.N62D_L253A_E375Y_K379R_A484E_K512Y.co |
| pET16.Btagcc.His10cc.Phi29.N62D_L253A_E375Y_S395K_A484E_K512Y.co |
| pET16.Btagcc.His10cc.Phi29.N62D_L253A_N313K_E375Y_A484E_K512Y.co |
| pET16.Btagcc.His10cc.Phi29.N62D_L253A_T372Q_E375Y_L384M_A484E_K512Y.co |
| pET16.Btagcc.His10cc.Phi29.N62D_Q171E_E175R_L253A_E375Y_A484E_K512Y.co |
| pET16.Btagcc.His10cc.Phi29.N62D_G217P_L253A_E375Y_A484E_K512Y.co |
| pET16.Btagcc.His10cc.Phi29.N62D_L253A_V276E_W277K_E375Y_A484E_K512Y.co |
| pET16.Btagcc.His10cc.Phi29.N62D_L253A_V276E_W277K_H284Y_E375Y_A484E_K512Y.co |
| pET16.Btagcc.His10cc.Phi29.N62D_L253A_E375Y_L386F_N387D_A484E_K512Y.co |
| pET16.Btagcc.His10cc.Phi29.N62D_L253A_A256S_E375Y_L386F_N387D_A484E_K512Y.co |
| pET16.Btagcc.His10cc.Phi29.N62D_L253A_Y369H_E375Y_A484E_K512Y.co |
| pET16.Btagcc.His10cc.Phi29.N62D_L253A_Y343R_E375Y_A484E_K512Y.co |
| pET16.Btagcc.His10cc.Phi29.N62D_L253A_Y343K_E375Y_A484E_K512Y.co |
| pET16.Btagcc.His10cc.Phi29.N62D_L253A_Y343S_E375Y_A484E_K512Y.co |
| pET16.Btagcc.His10cc.Phi29.N62D_L253A_Y343H_E375Y_A484E_K512Y.co |
| pET16.Btagcc.His10cc.Phi29.N62D_L253A_I323T_E375Y_A484E_K512Y.co |
| pET16.Btagcc.His10cc.Phi29.N62D_L253A_I323E_E375Y_A484E_K512Y.co |
| pET16.Btagcc.His10cc.Phi29.N62D_L253A_I323R_E375Y_A484E_K512Y.co |
| pET16.Btagcc.His10cc.Phi29.N62D_L253A_I323H_E375Y_A484E_K512Y.co |
| pET16.Btagcc.His10cc.Phi29.N62D_L253A_I323T_E375Y_Y434R_A484E_K512Y.co |
| pET16.Btagcc.His10cc.Phi29.N62D_L253A_F309H_E375Y_A484E_K512Y.co |
| pET16.Btagcc.His10cc.Phi29.N62D_L253A_F309R_E375Y_A484E_K512Y.co |
| pET16.Btagcc.His10cc.Phi29.N62D_L253A_F309S_E375Y_A484E_K512Y.co |
| pET16.Btagcc.His10cc.Phi29.N62D_L253A_F309E_E375Y_A484E_K512Y.co |
| pET16.Btagcc.His10cc.Phi29.N62D_L253A_F309S_Y319H_E375Y_A484E_K512Y.co |
| pET16.Btagcc.His10cc.Phi29.N62D_L253A_E375Y_L416S_A484E_K512Y.co |
| pET16.Btagcc.His10cc.Phi29.N62D_L253A_E375Y_L416K_A484E_K512Y.co |
| pET16.Btagcc.His10cc.Phi29.N62D_L253A_E375Y_L416R_A484E_K512Y.co |
| pET16.Btagcc.His10cc.Phi29.N62D_L253A_E375Y_L416E_A484E_K512Y.co |
| pET16.Btagcc.His10cc.Phi29.N62D_L253A_E375Y_L416D_A484E_K512Y.co |
| pET16.Btagcc.His10cc.Phi29.N62D_L253A_E375Y_L416Q_A484E_K512Y.co |
| pET16.Btagcc.His10cc.Phi29.N62D_L253A_E375Y_L416N_A484E_K512Y.co |
| pET16.Btagcc.His10cc.Phi29 D12A_L253A_E375Y_A484E_K512Y |
| pET16.Btagcc.His10cc.Phi29 D66K_L253A_E375Y_A484E_K512Y |
| pET16.Btagcc.His10cc.Phi29.D66M_L253A_E375Y_A484E_K512Y.co |
| pET16.Btagcc.His10cc.Phi29.D66R_L253A_E375Y_A484E_K512Y.co |
| pET16.Btagcc.His10cc.Phi29.N62H_L253A_E375Y_A484E_K512Y.co |
| pET16.Btagcc.His10cc.Clerm_His10.Phi29.N62H_L253A_E375Y_A484E_K512Y.co |
| pET16.Btagcc.His10cc.Phi29.T15I_L253A_E375Y_A484E_K512Y.co |
| pET16.Btagcc.His10cc.Phi29.Y148I_L253A_E375Y_A484E_K512Y.co |
| pET16.Btagcc.His10cc.Phi29.D66M_Y148I_L253A_E375Y_A484E_K512Y.co |
| pET16.Btagcc.His10cc.Phi29.H149M_L253A_E375Y_A484E_K512Y.co |
| pET16.Btagcc.His10cc.Phi29.L253A_E375Y_A484E_K512Y.co |

Fig. 34 (cont.)

| Description |
|---|
| pET16.Btagcc.His10cc.Phi29.L253A_E375Y_A484E_Q497H_K512Y.co |
| pET16.Btagcc.His10cc.Phi29.D66M_Y148A_L253A_E375Y_A484E_Q497H_K512Y.co |
| pET16.Btagcc.His10cc.Phi29.N62D_Y63A_L253A_E375Y_A484E_K512Y.co |
| pET16.Btagcc.His10cc.Phi29.N62D_M188K_L253A_E375Y_A484E_K512Y.co |
| pET16.Btagcc.His10cc.Phi29.N62D_M188H_L253A_E375Y_A484E_K512Y.co |
| pET16.Btagcc.His10cc.Phi29.N62D_T189A_L253A_E375Y_A484E_K512Y.co |
| pET16.Btagcc.His10cc.Phi29.N62D_L253A_E375Y_N387L_A484E_K512Y.co |
| pET16.Btagcc.His10cc.Phi29.N62D_L253A_E375Y_N387M_A484E_K512Y.co |
| pET16.Btagcc.His10cc.Phi29.N62D_L253A_E375Y_E420M_A484E_K512Y.co |
| pET16.Btagcc.His10cc.Phi29.N62D_L253A_E375Y_E420R_A484E_K512Y.co |
| pET16.Btagcc.His10cc.Phi29.N62D_L253A_E375Y_V399F_A484E_K512Y.co |
| pET16.Btagcc.His10cc.Phi29.N62D_L253A_E375Y_V399Y_A484E_K512Y.co |
| pET16.Btagcc.His10cc.Phi29.N62D_L253A_E375Y_K422A_A484E_K512Y.co |
| pET16.Btagcc.His10cc.Phi29.F131_N62D_L253A_E375Y_A484E_K512Y.co |
| pET16.Btagcc.His10cc.Phi29.N62D_L253A_E375Y_I474H_A484E_K512Y.co |
| pET16.Btagcc.His10cc.Phi29.N62D_L253A_E375Y_I474C_A484E_K512Y.co |
| pET16.Btagcc.His10cc.Cterm_His10gm.Phi29.N62H_L253A_E375Y_A484E_E508R_K512Y.co |
| pET16.Btagcc.His10cc.Phi29.N62H_L253A_Y148A_E375Y_A484E_K512Y.co |
| pET16.Btagcc.His10cc.CTerm_His10.Phi29.N62H_L253A_Y148A_E375Y_A484E_K512Y.co |
| pET16.Btagcc.His10cc.CTerm_His10cc.Phi29.N62H_L253A_E375Y_A484E_K512Y.co |
| pET16.Btagcc.His10cc.CTerm_His10.Phi29.N62D_L253A_E375Y_I375K_A484E_K512Y.co |
| pET16.Btagcc.His10cc.Phi29.N62D_L253A_T368G_E375Y_A484E_K512Y.co |
| pET16.Btagcc.His10cc.Phi29.N62D_L253M_E375Y_A484E_K512Y.co |
| pET16.Btagcc.His10cc.Phi29.N62D_L253G_E375Y_A484E_K512Y.co |
| pET16.Btagcc.His10cc.Phi29.N62D_L253C_E375Y_A484E_K512Y.co |
| pET16.Btagcc.His10cc.Phi29.N62D_L253Q_E375Y_A484E_K512Y.co |
| pET16.Btagcc.His10cc.Phi29.N62D_L253R_E375Y_A484E_K512Y.co |
| pET16.Btagcc.His10cc.Phi29.N62D_L253I_E375Y_A484E_K512Y.co |
| pET16.Btagcc.His10cc.Phi29.N62D_L253Y_E375Y_A484E_K512Y.co |
| pET16.Btagcc.His10cc.Phi29.N62D.co |
| pET16.Btagcc.His10cc.CTerm_His10.Phi29.L253A_E375Y_A484E_K512Y.co |
| pET16.Btagcc.His10cc.Phi29.L43_03_D6_N62D_D66M_T368F_E375Y_K512Y.co |
| pET16.Btagcc.His10cc.Phi29.N31E.co |
| pET16.Btagcc.His10cc.Phi29.D34N.co |
| pET16.Btagcc.His10cc.Phi29.S36D.co |
| pET16.Btagcc.His10cc.Phi29.D94E.co |
| pET16.Btagcc.His10cc.Phi29.T140P.co |
| pET16.Btagcc.His10cc.Phi29.K157E.co |
| pET16.Btagcc.His10cc.Phi29.A164E.co |
| pET16.Btagcc.His10cc.Phi29.I202L.co |
| pET16.Btagcc.His10cc.Phi29.V222I.co |
| pET16.Btagcc.His10cc.Phi29.Y224K.co |
| pET16.Btagcc.His10cc.Phi29.R226K.co |
| pET16.Btagcc.His10cc.Phi29.F237Y.co |
| pET16.Btagcc.His10cc.Phi29.W277K.co |
| pET16.Btagcc.His10cc.Phi29.H284Y.co |
| pET16.Btagcc.His10cc.Phi29.S307N.co |
| pET16.Btagcc.His10cc.Phi29.Y315F.co |

Fig. 34 (cont.)

| Description |
|---|
| pET16.Btagcc.His10co.Phi29.A324V.co |
| pET16.Btagcc.His10co.Phi29.W327Y.co |
| pET16.Btagcc.His10co.Phi29.S329T.co |
| pET16.Btagcc.His10co.Phi29.M338I.co |
| pET16.Btagcc.His10co.Phi29.L351F.co |
| pET16.Btagcc.His10co.Phi29.G518C.co |
| pET16.Btagcc.His10co.Phi29.Y521A.co |
| pET16.Btagcc.His10co.Phi29.D523T.co |
| pET16.Btagcc.His10co.Phi29.E540K.co |
| pET16.Btagcc.His10co.Phi29.R552S.co |
| pET16.Btagcc.His10co.Phi29.N62D_L253A_E375Y_P477D_A484E_K512Y.co |
| pET16.Btagcc.His10co.CTerm_His10co.Phi29.N62D_L253A_E375Y_P477D_A484E_K512Y.co |
| pET16.Btagcc.His10co.Phi29.F13I_L253A_E375Y_A484E_K512Y.co |
| pET16.Btagcc.His10co.Phi29.Y148K_L253A_E375Y_A484E_K512Y.co |
| pET16.Btagcc.His10co.Phi29.Y148H_L253A_E375Y_A484E_K512Y.co |
| pET16.Btagcc.His10co.Phi29.N62D_D103I_L253A_E375Y_A484E_K512Y.co |
| pET16.Btagcc.His10co.Phi29.N62D_L253W_I364A_D365S_E375Y_K379V_K383W_A484E_K512Y.co |
| pET16.Btagcc.His10co.Phi29.N62H.co |
| pET16.Btagcc.His10co.Phi29.D12R.co |
| pET16.Btagcc.His10co.Phi29.D66K.co |
| pET16.Btagcc.His10co.Phi29.D66M.co |
| pET16.Btagcc.His10co.Phi29.D66R.co |
| pET16.Btagcc.His10co.Phi29.Y148I.co |
| pET16.Btagcc.His10co.Phi29.Y148A.co |
| pET16.Btagcc.His10co.Phi29.D66M_Y148A.co |
| pET16.Btagcc.His10co.Phi29.N62H_Y148A.co |
| pET16.Btagcc.His10co.Phi29.N62D_L253A_E375Y_S385K_K512Y.co |
| pET16.Btagcc.His10co.Phi29.N62D_L253A_N313K_E375Y_A484E_K512Y_T534K.co |
| pET16.Btagcc.His10co.Phi29.N62D_F198S_L253A_E375Y_A484E_K512Y.co |
| pET16.Btagcc.His10co.Phi29.N62D_F128V_L253A_E375Y_A484E_K512Y.co |
| pET16.Btagcc.His10co.Phi29.N62D_F137T_L253A_E375Y_A484E_K512Y.co |
| pET16.Btagcc.His10co.Phi29.N62D_F137E_L253A_E375Y_A484E_K512Y.co |
| pET16.Btagcc.His10co.Phi29.N62D_L253A_W367L_E375Y_A484E_K512Y.co |
| pET16.Btagcc.His10co.Phi29.N62D_L253A_Y369G_E375Y_A484E_K512Y.co |
| pET16.Btagcc.His10co.Phi29.N62D_L253A_Y369K_E375Y_A484E_K512Y.co |
| pET16.Btagcc.His10co.Phi29.N62D_L253A_Y369L_E375Y_A484E_K512Y.co |
| pET16.Btagcc.His10co.Phi29.N62D_L253A_Y369N_E375Y_A484E_K512Y.co |
| pET16.Btagcc.His10co.Phi29.N62D_L253A_E375Y_M385L_A484E_K512Y.co |
| pET16.Btagcc.His10co.Phi29.N62D_L253A_E375Y_M385E_A484E_K512Y.co |
| pET16.Btagcc.His10co.Phi29.N62D_L253A_E375Y_M385R_A484E_K512Y.co |
| pET16.Btagcc.His10co.Phi29.N62D_L253A_E375Y_M385G_A484E_K512Y.co |
| pET16.Btagcc.His10co.Phi29.N62D_L253A_F363V_E375Y_A484E_K512Y.co |
| pET16.Btagcc.His10co.Phi29.N62D_L253A_F363A_E375Y_A484E_K512Y.co |
| pET16.Btagcc.His10co.Phi29.N62D_L253A_F363E_E375Y_A484E_K512Y.co |
| pET16.Btagcc.His10co.Phi29.N62D_L253A_F363R_E375Y_A484E_K512Y.co |
| pET16.Btagcc.His10co.Phi29.N62D_L253A_E375Y_A484E_511.1G_511.2S_512.1S_512.2S.co |
| pET16.Btagcc.His10co.Phi29.N62D_L253A_E375Y_Q380K_A484E_Q497K_K512Y.co |
| pET16.Btagcc.His10co.Cterm_His10co.Phi29.N62D_L253A_E375Y_A484E_E508R_K512Y.co |

Fig. 34 (cont.)

| Description |
|---|
| pET16.Btagco.Ctem_His10co.Phi29.N62D_L253A_E375Y_A484E_E508R_K512Y.co |
| pET16.Btagco.His10co.Phi29.L253A_E375Y_A484E_Q497K_K512Y.co |
| pET16.Btagco.His10co.CTerm_His10co.Phi29.N62H_E375Y_A484E_K512Y.co |
| pET16.Btagco.His10co.Phi29.N62H_E375Y_A484E_E508R_K512Y.co |
| pET16.Btagco.His10co.Phi29.N62H_L253A_E375Y_A484E_E508R_K512Y.co |
| pET16.Btagco.His10co.CTerm_His10co.Phi29.N62D_L253A_E375Y_A484E_K512Y.co |
| pET16.Btagco.His10co.Phi29.N62D_L253A_E375F_A484E_K512Y.co |
| pET16.Btagco.His10co.Phi29.N62D_L253A_E375F_A484E_K512F.co |
| pET16.Btagco.His10co.CTerm_His10co.Phi29.N62D_L253A_A484E_K512Y.co |
| pET16.Btagco.His10co.Phi29.N62D_L253A_A484E_K512Y.co |
| pET16.Btagco.His10co.Phi29.N62D_L253A_E375Y_A484E.co |
| pET16.Btagco.His10co.CTerm_His10co.Phi29.N62D_L253A_E375Y_A484E.co |
| pET16.Btagco.His10co.Phi29.N62D_L253A_A484E.co |
| pET16.Btagco.His10co.CTerm_His10co.Phi29.N62D_L253A_E375F_A484E_K512F.co |
| pET16.Btagco.His10co.CTerm_His10co.Phi29.N62D_L253A_E375F_A484E_K512Y.co |
| pET16.Btagco.His10co.CTerm_His10co.Phi29.N62D_L253A_E375Y_A484E_K512F.co |
| pET16.Btagco.His10co.Phi29.N62D_L253A_E375Y_A484E_I504K_K512Y.co |
| pET16.Btagco.His10co.Phi29.N62D_L253A_E375Y_A484E_I504R_K512Y.co |
| pET16.Btagco.His10co.Phi29.N62D_L253A_E375Y_A484E_E508V_K512Y.co |
| pET16.Btagco.His10co.Phi29.N62D_L253A_E375Y_A484E_E508K_K512Y.co |
| pET16.Btagco.His10co.Phi29.N62D_L253A_E375Y_A484E_D510K_K512Y.co |
| pET16.Btagco.His10co.Phi29.N62D_L253A_E375Y_A484E_D510R_K512Y.co |
| pET16.Btagco.His10co.Phi29.N62D_L253A_E375Y_A484E_K512Y_L513R.co |
| pET16.Btagco.His10co.Phi29.N62D_L253A_E375Y_A484E_K512Y_D523K.co |
| pET16.Btagco.His10co.Phi29.N62D_L253A_E375Y_A484E_K512Y_D523R.co |
| pET16.Btagco.His10co.Phi29.N62D_L253A_E375Y_A484E_K512Y_I534R.co |
| pET16.Btagco.His10co.CTerm_His10co.Phi29.N62D_E375Y_A437E_A484E_K512Y.co |
| pET16.Btagco.His10co.CTerm_His10co.Phi29.N62D_E375Y_C455G_A484E_K512Y.co |
| pET16.Btagco.His10co.Phi29.N62D_N88G_L253A_E375Y_A484E_K512Y.co |
| pET16.Btagco.His10co.Phi29.N62D_S111P_K112D_L253A_E375Y_A484E_K512Y.co |
| pET16.Btagco.His10co.Phi29.N62D_S111P_L253A_E375Y_A484E_K512Y.co |
| pET16.Btagco.His10co.Phi29.N62D_K112D_L253A_E375Y_A484E_K512Y.co |
| pET16.Btagco.His10co.Phi29.N62D_K113N_L253A_E375Y_A484E_K512Y.co |
| pET16.Btagco.His10co.Phi29.N62D_K113S_L253A_E375Y_A484E_K512Y.co |
| pET16.Btagco.His10co.Phi29.N62D_V154P_L253A_E375Y_A484E_K512Y.co |
| pET16.Btagco.His10co.Phi29.N62D_K238P_L253A_E375Y_A484E_K512Y.co |
| pET16.Btagco.His10co.Phi29.N62D_K238E_E239G_L253A_E375Y_A484E_K512Y.co |
| pET16.Btagco.His10co.Phi29.N62D_L253A_E279P_E375Y_A484E_K512Y.co |
| pET16.Btagco.His10co.Phi29.N62D_L253A_E296P_E375Y_A484E_K512Y.co |
| pET16.Btagco.His10co.Phi29.N62D_L253A_G330N_E375Y_A484E_K512Y.co |
| pET16.Btagco.His10co.Phi29.N62D_L253A_E375Y_E408P_A484E_K512Y.co |
| pET16.Btagco.His10co.Phi29.N62D_L253A_E375Y_K407D_E408P_A484E_K512Y.co |
| pET16.Btagco.His10co.Phi29.N62D_L253A_E375Y_Y448P_A484E_K512Y.co |
| pET16.Btagco.His10co.Phi29.N62D_L253A_E375Y_D469P_A484E_K512Y.co |
| pET16.Btagco.His10co.Phi29.N62D_L253A_E375Y_K478D_A484E_K512Y.co |
| pET16.Btagco.His10co.Phi29.N62D_L253A_E375Y_A484E_K512Y_V548P.co |
| pET16.Btagco.His10co.Phi29.N62D_D84P_L253A_E375Y_A484E_K512Y.co |

- pET16.Btag.His10co.N62D.C106S.L253A.E375Y.A484E.K512Y.co
- pET16.Btag.His10co.N62D.C106S.L253A.E375Y.C448V.A484E.K512Y.co
- pET16.Btag.His10co.N62D.L253A.R261K.E375Y.A484E.K512Y.co
- pET16.Btag.His10co.N62D.R236K.L253A.E375Y.A484E.K512Y.co
- pET16.Btag.His10co.N62D.L253A.E375Y.K478R.K479R.A484E.K512Y.co
- pET16.Btag.His10co.N62D.K135R.L253A.E375Y.K478R.A484E.K512Y.co
- pET16.Btag.His10co.N62D.C106S.L253A.T372C.E375Y.A484E.K512Y.co
- pET16.Btag.His10co.N62D.C106S.K135C.L253A.E375Y.A484E.K512Y.co
- pET16.Btag.His10co.N62D.C106S.K138C.L253A.E375Y.A484E.K512Y.co
- pET16.Btag.His10co.N62D.C106S.L253A.E375Y.A484E.D510C.K512Y.co
- pET16.Btag.His10co.N62D.C106S.L253A.E375Y.A484E.K512C.co
- pET16.Btagco.His10co.N62D.L253A.E375Y.A484E.K512Y.co
- pET16.Btagco.His10co.Cterm.His10co.Phi29.N62D.L253A.A484E.co
- pET16.Btagco.His10co.Cterm.His10co.Phi29.N62D.A83P.L253A.E375Y.A484E.K512Y.co
- pET16.Btagco.His10co.Cterm.His10co.Phi29.N62D.E239G.L253A.E375Y.A484E.K512Y.co
- pET16.Btagco.His10co.Cterm.His10co.Phi29.V130S.L253A.E375Y.A484E.K512Y.co
- pET16.Btagco.His10co.Cterm.His10co.Phi29.V130K.L253A.E375Y.A484E.K512Y.co
- pET16.Btagco.His10co.Cterm.His10co.Phi29.L253A.E375Y.A484E.K512Y.T571A.co
- pET16.Btagco.His10co.Cterm.His10co.Phi29.L253A.E375Y.A484E.K512Y.T571K.co
- pET16.Btagco.His10co.Cterm.His10co.Phi29.N62D.D104I.L253A.E375Y.A484E.K512Y.co
- pET16.Btagco.His10co.Cterm.His10co.Phi29.N62D.L253A.K311P.E375Y.A484E.K512Y.co
- pET16.Btagco.His10co.Cterm.His10co.Phi29.N62D.L253A.Q286I.E375Y.A484E.K512Y.co
- pET16.Btagco.His10co.Cterm.His10co.Phi29.G191A.L253A.E375Y.A484E.Q497K.K512Y.co
- pET16.Btagco.His10co.Cterm.His10co.Phi29.Q380K.A484E.Q497K.K512Y.co
- pET16.Btagco.His10co.Cterm.His10co.Phi29.L253A.E375Y.A484E.E508R.K512Y.co
- pET16.Btagco.His10co.Cterm.His10co.Phi29.N62H.L253A.E375Y.A484E.Q497K.K512Y.co
- pET16.Btagco.His10co.Cterm.His10co.Phi29.L253A.E375Y.Q380K.A484E.Q497K.K512Y.co
- pET16.Btagco.His10co.Cterm.His10co.Phi29.L253A.E375Y.Q380K.A484E.E508R.K512Y.co
- pET16.Btagco.His10co.Cterm.His10co.Phi29.L253A.E375Y.A484E.Q497K.E508R.K512Y.co
- pET16.Btagco.His10co.Cterm.His10co.Phi29.N62H.L253A.E375Y.Q380K.A484E.Q497K.E508R.K512Y.co

Fig. 35 (cont'd)

| Construct |
|---|
| pET16.Btag.His10co.N62D_V250M_L253A_E375Y_A484E_K512Y.co |
| pET16.Btag.His10co.N62D_V250I_L253A_E375Y_A484E_K512Y.co |
| pET16.Btag.His10co.N62D_V250L_L253A_E375Y_A484E_K512Y.co |
| pET16.Btag.His10co.N62D_V250M_L253A_E375Y_T440S_A484E_K512Y.co |
| pET16.Btag.His10co.N62D_V250I_L253A_E375Y_T440S_A484E_K512Y.co |
| pET16.Btag.His10co.N62D_V250L_L253A_E375Y_T440S_A484E_K512Y.co |
| pET16.Btag.His10co.N62D_V250M_L253A_E375Y_A437M_A484E_K512Y.co |
| pET16.Btag.His10co.N62D_V250I_L253A_E375Y_A437M_A484E_K512Y.co |
| pET16.Btag.His10co.N62D_V250L_L253A_E375Y_A437M_A484E_K512Y.co |
| pET16.Btag.His10co.N62D_V250M_L253A_E375Y_A437S_A484E_K512Y.co |
| pET16.Btag.His10co.N62D_V250I_L253A_E375Y_A437S_A484E_K512Y.co |
| pET16.Btag.His10co.N62D_V250L_L253A_E375Y_A437S_A484E_K512Y.co |
| pET16.Btag.His10co.N62D_V250M_L253A_E375Y_A437M_T440S_A484E_K512Y.co |
| pET16.Btag.His10co.N62D_V250I_L253A_E375Y_A437M_T440S_A484E_K512Y.co |
| pET16.Btag.His10co.N62D_V250L_L253A_E375Y_A437M_T440S_A484E_K512Y.co |
| pET16.Btag.His10co.N62D_V250M_L253A_E375Y_A437S_T440S_A484E_K512Y.co |
| pET16.Btag.His10co.N62D_V250I_L253A_E375Y_A437S_T440S_A484E_K512Y.co |
| pET16.Btag.His10co.N62D_V250L_L253A_E375Y_A437S_T440S_A484E_K512Y.co |
| pET16.Btag.His10co.Phi29.L253A_E375Y_A437M_A484E_K512Y.co |
| pET16.Btag.His10co.Phi29.L253A_E375Y_A484E_K512Y_V514K_D523F.co |
| pET16.Btag.His10co.Phi29.L253A_H284N_E375Y_A484E_K512Y_V514K_D523F.co |
| pET16.Btag.His10co.Phi29.N62D_Y224R_L253A_E375Y_A484E_K512Y.co |
| pET16.Btag.His10co.Phi29.N62D_Y224I_L253A_E375Y_A484E_K512Y.co |
| pET16.Btag.His10co.Phi29.N62D_V222I_L253A_E375Y_A484E_K512Y.co |
| pET16.Btag.His10co.Phi29.N62D_L253A_I262P_E375Y_A484E_K512Y.co |
| pET16.Btag.His10co.Phi29.N62D_L253A_T368G_E375Y_A484E_K512Y.co |
| pET16.Btaqco.His10co.CTerm_His10co.Phi29.N62D_L253A_T368G_E375Y_A484Q_K512Y.co |
| pET16.Btaqco.His10co.CTerm_His10co.Phi29.N62D_L253A_E375Y_A484Q_K512Y.co |
| pET16.Btaqco.His10co.CTerm_His10co.Phi29.N62D_V222I_L253A_E375Y_A484E_K512Y.co |
| pET16.Btaqco.His10co.CTerm_His10co.Phi29.N62D_L253A_E375Y_A484E_K512Y.co |
| pET16.Btaqco.His10co.CTerm_His10co.Phi29.N62D_Pro10co.Phi29.E239G_L253A_E375Y_A484E_K512Y.co |
| pET16.BtaqV7co.His10co.CTerm_His10co.N62D_S215D_L253A_E375Y_A484E_D510K_K512Y.co |
| pET16.Btaqco.His10co.CTerm_His10co.N62D_G191A_L253A_E375Y_A484E_K512Y.co |

| # | Construct |
|---|---|
| 1 | pET16.BtagcoV7co.His10co.Phi29.L253A.T368F.E375Y.A484E.Q497K.K512Y.co |
| 2 | p

| Vector | Mutations |
|---|---|
| pET16.Btagco.His10co.CTerm | Phi29 E239G L253A E375Y A484E K512Y.co |
| pET16.Btagco.His10co.CTerm | Phi29 Y224R L253A E375Y A484E K512Y.co |
| pET16.Btagco.His10co.CTerm | Phi29 S215D L253A E375Y A484E K512Y.co |
| pET16.Btagco.His10co.CTerm | Phi29 A176V L253A E375Y A484E K512Y.co |
| pET16.Btagco.His10co.CTerm | Phi29 L253C E375Y A484E K512Y.co |
| pET16.Btagco.His10co.CTerm | Phi29 L253S E375Y A484E K512Y.co |
| pET16.Btagco.His10co.CTerm | Phi29 Y224K E239G L253A V277E W277K H284Y F309S Y310H Y369H E375Y A484E E508K K512Y.co |
| pET16.Btagco.His10co.CTerm | Phi29 Y224K L253A V276E W277K H284Y F309S Y310H Y369H E375Y K478D A484E E508K K512Y.co |
| pET16.Btagco.His10co.CTerm | Phi29 Y224K L253A V276E W277K H284Y F309S Y310H Y369H E375Y A484E E508K K512Y.co |
| pET16.Btagco.His10co.CTerm | Phi29 E239G L253A V276E W277K H284Y F309S Y310H Y369H E375Y A484E E508K K512Y.co |
| pET16.Btagco.His10co.CTerm | Phi29 C106S L253A V276E W277K H284Y F309S Y310H Y369H E375Y C448V A484V D510K K512Y.co |
| pET16.Btagco.His10co.CTerm | Phi29 E239G L253A E375Y A484E K512Y.co |
| pET16.Btagco.His10co.CTerm | Phi29 L253A E375Y K478D A484E K512Y.co |
| pET16.Btagco.His10co.CTerm | Phi29 L253A E375Y A484N K512Y.co |
| pET16.Btagco.His10co.CTerm | Phi29 L253A E375Y A484D K512Y.co |
| pET16.Btagco.His10co.CTerm | Phi29 L253A E375Y A484Q K512Y.co |
| pET16.Btagco.His10co.CTerm | Phi29 L253A T368G E375Y A484E E486Q K512Y.co |
| pET16.Btagco.His10co.CTerm | Phi29 L253A T368G E375Y A484E K512Y.co |
| pET16.Btagco.His10co.CTerm | Phi29 L253A E375Y A484E K512Y.co |
| pET16.Btagco.His10co.CTerm | Phi29 L253A E375A A484E K512Y.co |
| pET16.Btagco.His10co.CTerm | Phi29 L253A E375C A484E K512Y.co |
| pET16.Btagco.His10co.CTerm | Phi29 L253A E375G A484E K512Y.co |
| pET16.Btagco.His10co.CTerm | Phi29 L253A E375H A484E K512Y.co |
| pET16.Btagco.His10co.CTerm | Phi29 L253A E375K A484E K512Y.co |
| pET16.Btagco.His10co.CTerm | Phi29 L253A E375N A484E K512Y.co |
| pET16.Btagco.His10co.CTerm | Phi29 L253A E375Q A484E K512Y.co |
| pET16.Btagco.His10co.CTerm | Phi29 L253A E375R A484E K512Y.co |
| pET16.Btagco.His10co.CTerm | Phi29 L253A E375S A484E K512Y.co |
| pET16.Btagco.His10co.CTerm | Phi29 L253A E375T A484E K512Y.co |
| pET16.Btagco.His10co.CTerm | Phi29 L253A E375Y A484E K512C.co |
| pET16.Btagco.His10co.CTerm | Phi29 L253A E375Y A484E K512E.co |
| pET16.Btagco.His10co.CTerm | Phi29 L253A E375Y A484E K512G.co |

| | | | | | | | | | | | | | | | | | | | | | | | | | | | | | | |
|---|---|---|---|---|---|---|---|---|---|---|---|---|---|---|---|---|---|---|---|---|---|---|---|---|---|---|---|---|---|---|
| pET16.Btag.V7co.His10co.CTerm.Phi29.Y148I.K205A.E239G.V250I.L253A.E375Y.A484E.D510K.K512Y.co |
| pET16.Btag.V7co.His10co.CTerm.Phi29.Y148I.K205Q.E239G.V250I.L253A.E375Y.A484E.D510K.K512Y.co |
| pET16.Btag.V7co.His10co.CTerm.Phi29.Y148I.Y224K.E239G.V250I.L253A.E375Y.A484E.K512Y.co |
| pET16.Btag.V7co.His10co.CTerm.Phi29.Y148I.Y224K.E205E.V250I.L253A.K472A.A484E.K512Y.co |
| pET16.Btag.V7co.His10co.CTerm.Phi29.Y148I.Y224K.E239G.V250I.L253A.E375Y.K472A.A484E.K512Y.co |
| pET16.Btag.V7co.His10co.CTerm.Phi29.Y148I.Y224K.E239G.V250I.L253A.E375Y.K472Q.A484E.K512Y.co |
| pET16.Btag.V7co.His10co.CTerm.Phi29.Y148I.Y224K.E239G.V250I.L253A.E375Y.K472L.A484E.K512Y.co |
| pET16.Btag.V7co.His10co.CTerm.Phi29.Y148I.Y224K.E239G.V250I.L253A.E375Y.D473N.A484E.K512Y.co |
| pET16.Btag.V7co.His10co.CTerm.Phi29.Y148I.Y224K.E239G.V250I.L253A.E375Y.D473K.A484E.K512Y.co |
| pET16.Btag.V7co.His10co.CTerm.Phi29.Y148I.Y224K.E239G.V250I.L253A.E375Y.A484E.E508K.G511K.K512Y.co |
| pET16.Btag.V7co.His10co.CTerm.Phi29.Y148I.Y224K.E239G.V250I.L253A.E375Y.A484E.G511K.K512Y.co |
| pET16.Btag.V7co.His10co.CTerm.Phi29.Y148I.Y224K.E239G.V250I.L253A.E375Y.A484E.D510H.K512Y.co |
| pET16.Btag.V7co.His10co.CTerm.Phi29.Y148I.Y224K.E239G.V250I.L253A.E375Y.A484E.D510K.K512Y.co (-D510K) |
| pET16.Btag.V7co.His10co.CTerm.Phi29.Y148I.Y224K.E239G.V250I.L253A.E375Y.A484E.K512Y.co |
| pET16.Btag.V7co.His10co.CTerm.Phi29.Y148I.Y224K.E239G.V250I.L253A.E375Y.A484E.D510K.K539Q.co |
| pET16.Btag.V7co.His10co.CTerm.Phi29.Y148I.Y224K.E239G.V250I.L253A.E375Y.A484E.D510K.K536Q.co |
| pET16.Btag.V7co.His10co.CTerm.Phi29.Y148I.Y224K.E239G.V250I.L253A.E375Y.A484E.D510K.K536E.co |
| pET16.Btag.V7co.His10co.CTerm.Phi29.Y148I.Y224K.E239G.V250I.L253A.E375Y.K472A.A484E.D510K.K512Y.co |
| pET16.Btag.V7co.His10co.CTerm.Phi29.Y148I.Y224K.E239G.V250I.L253A.E375Y.K472Q.A484E.D510K.K512Y.co |
| pET16.Btag.V7co.His10co.CTerm.Phi29.Y148I.Y224K.E239G.V250I.L253A.E375Y.D473N.A484E.D510K.K512Y.co |
| pET16.Btag.V7co.His10co.CTerm.Phi29.Y148I.Y224K.E239G.V250I.L253A.E375Y.D473K.A484E.D510K.K512Y.co |
| pET16.Btag.V7co.His10co.CTerm.Phi29.Y148I.Y224K.E239G.V250I.L253A.E375Y.K507R.A484E.D510K.K512Y.co |
| pET16.Btag.V7co.His10co.CTerm.Phi29.Y148I.Y224K.E239G.V250I.L253A.E375Y.K479Q.A484E.D510K.K512Y.co |
| pET16.Btag.V7co.His10co.CTerm.Phi29.Y148I.Y224K.E239G.V250I.L253A.E375Y.K479E.A484E.D510K.K512Y.co |
| pET16.Btag.V7co.His10co.CTerm.Phi29.Y148I.Y224K.E239G.V250I.L253A.E375Y.K478Q.A484E.D510K.K512Y.co |
| pET16.Btag.V7co.His10co.CTerm.Phi29.Y109R.Y148I.Y224K.E239G.V250I.L253A.E375Y.A484E.D510K.K512Y.F526L.co |
| pET16.Btag.V7co.His10co.CTerm.Phi29.D66N.Y148I.Y224K.E239G.V250I.L253A.E375Y.F526L.co |
| pET16.Btag.V7co.His10co.CTerm.Phi29.Y109R.Y148I.Y224K.E239G.V250I.L253A.E375Y.A484E.D510K.K512Y.F526L.co |
| pET16.Btag.V7co.His10co.CTerm.Phi29.P127A.Y148I.Y224K.E239G.V250I.L253A.E375Y.A484E.D510K.K512Y.F526L.co |
| pET16.Btag.V7co.His10co.CTerm.Phi29.P127L.Y148I.Y224K.E239G.V250I.L253A.E375Y.A484E.D510K.K512Y.F526L.co |
| pET16.Btag.V7co.His10co.CTerm.Phi29.P127I.Y148I.Y224K.E239G.V250I.L253A.E375Y.A484E.D510K.K512Y.F526L.co |

```
LDKEVRYAYRGG          Phage Phi29

MDKEIRKAYRGG          Phage M2
VNSEIRKAYKGG          Phage GA-1
IDTEIRKAYRGG          Phage AV-1
```

Fig. 37A

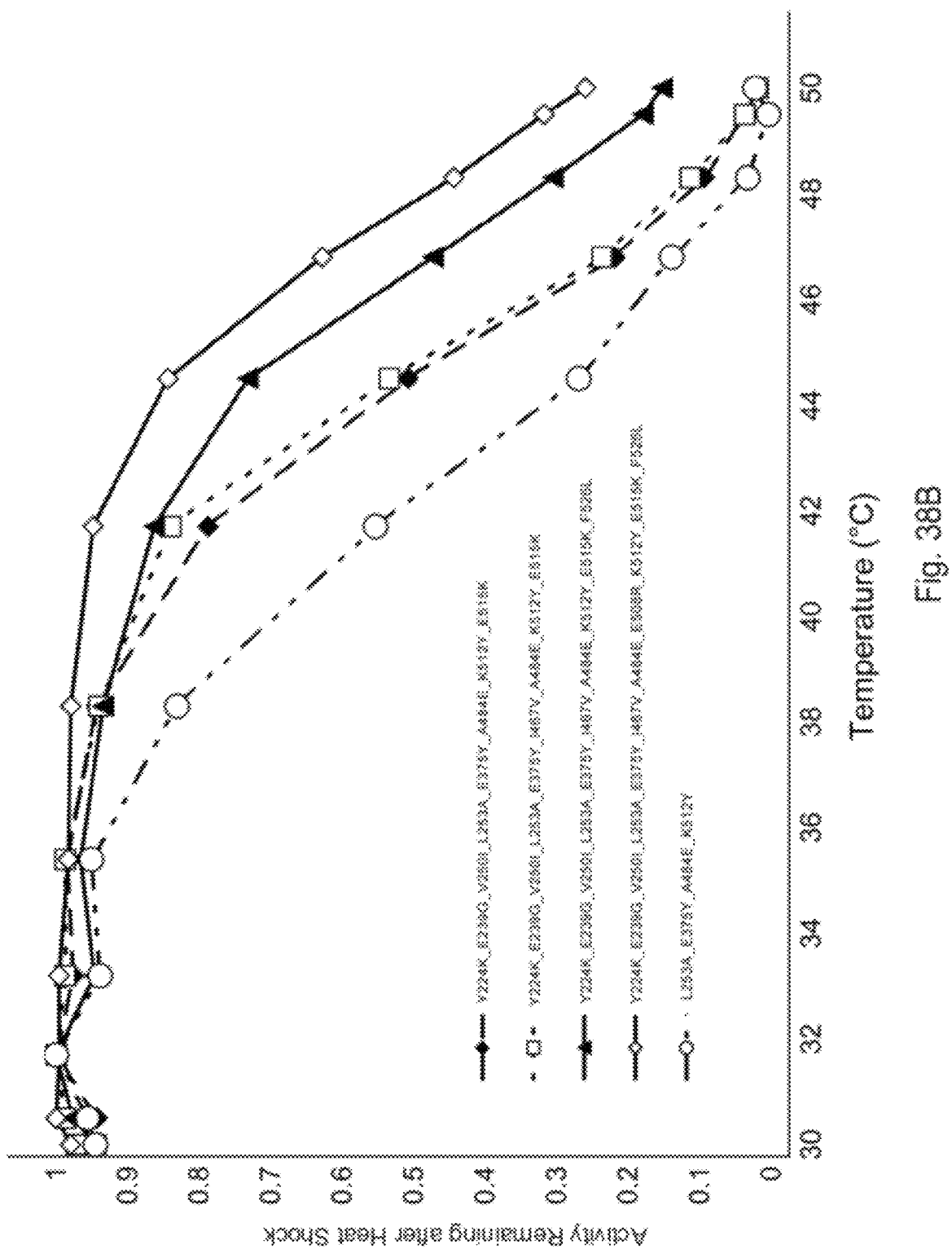

```
M2Y    1    MSRKMFSCDFETTTKLDDCRVWAYGYMEIGNLDNYKIGNSLDEFMQWVMEIQADLYPHNL    60
            M RKM SCDFETTTK  DCRVWAYGYM I    YKIGNSLDEFM WV   QADLYPHNL
φ29    4    MPRKMYSCDFETTTKVEDCRVWAYGYMNIEDHSEYKIGNSLDEFMAWVLKVQADLYPHNL    63

M2Y    61   KFDGAFIVNWLEQHGFKWSNEGLPNTYNTIISRMGQWYMIDICPGYKGKRKLHTVIYDSL   120
            KFDGAFI NWLE  GFKWS  GLPNTYNTIIS MGQWYMIDIC GYKGKRK HTVIYDSL
φ29    64   KFDGAFIINWLERNGFKWSADGLPNTYNTIISRMGQWYMIDICLGYKGKRKIHTVIYDSL   123

M2Y    121  KKLPFPVKKIAKDPQLPLLKGDIDYHTERPVGHEITPEEYEYIKNDIEIIARALDIQFKQ   180
            KKLPFPVKKIAKDP L  LKGDIDYH ERPVG  ITPEEY YIKNDI IIA AL IQFKQ
φ29    134  KKLPFPVKKIAKDFKLTVLKGDIDYHKERPVGYKITPEEYAYIKNDIQIIAEALLIQFKQ   183

M2Y    181  GLDRMTAGSDSLKGFKDILSTKKFNKVFPKLSLPMDKEIRKAYRGGPTWLNDKYKEKEIG   240
            GLDRMTAGSDSLKGFKDI  TKKF KVFP LSL  DKE R  AYRGGPTWLND   KEKEIG
φ29    184  GLDRMTAGSDSLKGFKDIITTKKFKKVFPTLSLGLDKEVRYAYRGGFTWLNDRFKEKEIG   243

M2Y    241  EGMVFDVNSLYPSQMYSRPLPYGAPIVFQGKYEKDEQYPLYIQRIRFEFELKEGYIPTIQ   300
            EGMVFDVNSLYP QMYSR LPYG PIVF GKY  DE YPL IQ IR EFELKEGYIPTIQ
φ29    244  EGMVFDVNSLYPAQMYSRLLPYGEPIVFEGKYVWDEDYPLHIQHIRCEFELKEGYIPTIQ   303

M2Y    301  IKKNPFFKGNEYLKNSGVEPVELYLTNVDLELIQEHYELYNVEYIDGFKFREKTGLFKDF   360
            IK   F KGNEYLK SG E   L L NVDLEL   EHY LYNVEYI G KF  TGLFKDF
φ29    304  IKRSRFYKGNEYLKSSGGEIADLWLSNVDLELMKEHYDLYNVEYISGLKFKATTGLFKDF   363

M2Y    361  IDKWTYVKTHEEGAKKQLAKLMLNSLYGKFASNPDVTGKVPYLKDDGSLGFRVGDEEYKD   420
            IDKWTY KT  EGA KQLAKLMLNSLYGKFASNPDVTGKVPYLK  G LGFR G EE KD
φ29    364  IDKWTYIKTTSEGAIKQLAKLMLNSLYGKFASNPDVTGKVPYLKENGALGFRLGEEETKD   423

M2Y    421  PVYTPMGVFITAWARFTTITAAQACYDRIIYCDTDSIHLTGTEVPEIIKDIVDPKKLGYW   480
            PVYTPMGVFITAWAR TTITAAQACYDRIIYCDTDSIHLTGTE P  IKDIVDPKKLGYW
φ29    424  PVYTPMGVFITAWARYTTITAAQACYDRIIYCDTDSIHLTGTEIPDVIKDIVDPKKLGYW   483

M2Y    481  AHESTFKRAKYLRQKTYIQDIYVKEVDGKLKECSPDEATTTKFSVKCAGMTDTIKKKVTF   540
            AHESTFKRAKYLRQKTYIQDIY KEVDGKL E SPD  T  KFSVKCAGMTD IKK VTF
φ29    484  AHESTFKRAKYLRQKTYIQDIYMKEVDGKLVESPDDYTDIKFSVKCAGMTDKIKKEVTF   543

M2Y    541  DNFAVGFSSMGKPKPVQVNGGVVLVDSVPTIK   572
             NF VGFS  KPKPVQV GGVVLVD  PTIK
φ29    544  ENFKVGFSRKMKPKPVQVPGGVVLVDDTPTIK   575
```

Fig. 43

RECOMBINANT POLYMERASES FOR IMPROVED SINGLE MOLECULE SEQUENCING

CROSS-REFERENCE TO RELATED APPLICATIONS

This application is a non-provisional utility patent application claiming priority to and benefit of provisional patent application U.S. Ser. No. 61/399,108, filed Jul. 6, 2010, entitled "RECOMBINANT POLYMERASES FOR IMPROVED SINGLE MOLECULE SEQUENCING" by Robin Emig et al. and is a continuation-in-part of U.S. Ser. No. 12/924,701, filed Sep. 30, 2010, entitled "GENERATION OF MODIFIED POLYMERASES FOR IMPROVED ACCURACY IN SINGLE MOLECULE SEQUENCING" by Sonya Clark et al., which claims priority to and benefit of provisional application U.S. Ser. No. 61/278,041, filed Sep. 30, 2009, entitled "GENERATION OF MODIFIED POLYMERASES FOR IMPROVED ACCURACY IN SINGLE MOLECULE SEQUENCING" by Sonya Clark et al. and which is a continuation-in-part of U.S. Ser. No. 12/384,112, filed Mar. 30, 2009, entitled "GENERATION OF MODIFIED POLYMERASES FOR IMPROVED ACCURACY IN SINGLE MOLECULE SEQUENCING" by Sonya Clark et al., which claims priority to and benefit of the following prior provisional patent applications: U.S. Ser. No. 61/072,645, filed Mar. 31, 2008, entitled "GENERATION OF POLYMERASES WITH IMPROVED CLOSED COMPLEX STABILITY AND DECREASED BRANCHING RATE" by Sonya Clark et al., and U.S. Ser. No. 61/094,843, filed Sep. 5, 2008, entitled "ENGINEERING POLYMERASES FOR MODIFIED INCORPORATION PROPERTIES" by Pranav Patel et al. Each of these applications is incorporated herein by reference in its entirety for all purposes.

BACKGROUND OF THE INVENTION

DNA polymerases replicate the genomes of living organisms. In addition to this central role in biology, DNA polymerases are also ubiquitous tools of biotechnology. They are widely used, e.g., for reverse transcription, amplification, labeling, and sequencing, all central technologies for a variety of applications such as nucleic acid sequencing, nucleic acid amplification, cloning, protein engineering, diagnostics, molecular medicine, and many other technologies.

Because of the significance of DNA polymerases, they have been extensively studied. This study has focused, e.g., on phylogenetic relationships among polymerases, structure of polymerases, structure-function features of polymerases, and the role of polymerases in DNA replication and other basic biological processes, as well as ways of using DNA polymerases in biotechnology. For a review of polymerases, see, e.g., Hübscher et al. (2002) "Eukaryotic DNA Polymerases" Annual Review of Biochemistry Vol. 71: 133-163, Alba (2001) "Protein Family Review: Replicative DNA Polymerases" Genome Biology 2(1): reviews 3002.1-3002.4, Steitz (1999) "DNA polymerases: structural diversity and common mechanisms" J Biol Chem 274:17395-17398, and Burgers et al. (2001) "Eukaryotic DNA polymerases: proposal for a revised nomenclature" J Biol. Chem. 276(47): 43487-90. Crystal structures have been solved for many polymerases, which often share a similar architecture. The basic mechanisms of action for many polymerases have been determined.

A fundamental application of DNA technology involves various labeling strategies for labeling a DNA that is produced by a DNA polymerase. This is useful in DNA sequencing, microarray technology, SNP detection, cloning, PCR analysis, and many other applications. Labeling is often performed in various post-synthesis hybridization or chemical labeling schemes, but DNA polymerases have also been used to directly incorporate various labeled nucleotides in a variety of applications, e.g., via nick translation, reverse transcription, random priming, amplification, the polymerase chain reaction, etc. See, e.g., Giller et al. (2003) "Incorporation of reporter molecule-labeled nucleotides by DNA polymerases. I. Chemical synthesis of various reporter group-labeled 2'-deoxyribonucleoside-5'-triphosphates" Nucleic Acids Res. 31(10):2630-2635, Augustin et al. (2001) "Progress towards single-molecule sequencing: enzymatic synthesis of nucleotide-specifically labeled DNA" J. Biotechnol. 86:289-301, Tonon et al. (2000) "Spectral karyotyping combined with locus-specific FISH simultaneously defines genes and chromosomes involved in chromosomal translocations" Genes Chromosom. Cancer 27:418-423, Zhu and Waggoner (1997) "Molecular mechanism controlling the incorporation of fluorescent nucleotides into DNA by PCR" Cytometry, 28:206-211, Yu et al. (1994) "Cyanine dye dUTP analogs for enzymatic labeling of DNA probes" Nucleic Acids Res. 22:3226-3232, Zhu et al. (1994) "Directly labeled DNA probes using fluorescent nucleotides with different length linkers" Nucleic Acids Res. 22:3418-3422, and Reid et al. (1992) "Simultaneous visualization of seven different DNA probes by in situ hybridization using combinatorial fluorescence and digital imaging microscopy" Proc. Natl. Acad. Sci. USA, 89:1388-1392.

DNA polymerase mutants have been identified that have a variety of useful properties, including altered nucleotide analog incorporation abilities relative to wild-type counterpart enzymes. For example, Vent$^{A488L}$ DNA polymerase can incorporate certain non-standard nucleotides with a higher efficiency than native Vent DNA polymerase. See Gardner et al. (2004) "Comparative Kinetics of Nucleotide Analog Incorporation by Vent DNA Polymerase" J. Biol. Chem. 279 (12):11834-11842 and Gardner and Jack "Determinants of nucleotide sugar recognition in an archaeon DNA polymerase" Nucleic Acids Research 27(12):2545-2553. The altered residue in this mutant, A488, is predicted to be facing away from the nucleotide binding site of the enzyme. The pattern of relaxed specificity at this position roughly correlates with the size of the substituted amino acid side chain and affects incorporation by the enzyme of a variety of modified nucleotide sugars.

Additional modified polymerases, e.g., modified polymerases that display improved properties useful for single molecule sequencing (SMS) and other polymerase applications (e.g., DNA amplification, sequencing, labeling, detection, cloning, etc.), are desirable. The present invention provides new recombinant DNA polymerases with desirable properties including one or more slow catalytic steps during the polymerase kinetic cycle relative to a wild-type or parental polymerase. The one or more slow catalytic steps can be achieved by introducing one or more functionalities into the polymerase, e.g., enhanced metal coordination, closed conformation stabilization, enhanced or destabilized interactions with certain portions of a nucleotide or nucleotide analog (e.g., the base, a phosphate group, or the label of a labeled analog), altered polyphosphate release, slower polymerase translocation, and/or strengthened or weakened interactions with the phosphate tail of a nucleotide analog. Other exemplary properties include exonuclease deficiency, increased closed complex stability, altered (e.g., reduced) branching fraction, altered cofactor selectivity, increased yield, increased thermostability, increased accuracy, increased speed, increased readlength, and the like. Also included are methods of making and using such polymerases, and many other features that will become apparent upon a complete review of the following.

SUMMARY OF THE INVENTION

Modified DNA polymerases can find use in such applications as, e.g., single-molecule sequencing (SMS), genotyping analyses such as SNP genotyping using single-base extension methods, and real-time monitoring of amplification, e.g., RT-PCR. Among other aspects, the invention provides compositions comprising recombinant polymerases that comprise mutations which confer properties which can be particularly desirable for these applications. These properties can, e.g., facilitate readout accuracy or otherwise improve polymerase performance. Also provided by the invention are methods of generating such modified polymerases and methods in which such polymerases can be used to, e.g., sequence a DNA template and/or make a DNA.

One general class of embodiments provides a composition comprising a recombinant Φ29-type DNA polymerase, which recombinant polymerase comprises a mutation at position E375, a mutation at position K512, and a mutation at one or more positions selected from the group consisting of L253, A484, V250, E239, Y224, Y148, E508, and T368, wherein identification of positions is relative to wild-type Φ29 polymerase (SEQ ID NO:1).

Suitable mutations include amino acid substitutions, insertions, and deletions. Thus, the mutation at position E375 can be, for example, an amino acid substitution selected from the group consisting of E375Y, E375F, E375R, E375Q, E375H, E375L, E375A, E375K, E375S, E375T, E375C, E375G, and E375N. The mutation at position K512 can be, for example, an amino acid substitution selected from the group consisting of K512Y, K512F, K512I, K512M, K512C, K512E, K512G, K512H, K512N, K512Q, K512R, K512V, and K512H. In one class of embodiments, the mutation at position E375 comprises an E375Y substitution and the mutation at position K512 comprises a K512Y substitution. The polymerase optionally comprises one or more insertions of at least one amino acid (e.g., one, two or more amino acids), e.g., between positions 507 and 508, between positions 511 and 512, and/or between positions 512 and 513.

Exemplary mutations at positions L253, A484, V250, E239, Y224, Y148, E508, and T368 include, e.g., L253A, L253C, L253S, A484E, A484Q, A484N, A484D, A484K, V250I, V250Q, V250L, V250M, V250C, V250F, V250N, V250R, V250T, V250Y, E239G, Y224K, Y224Q, Y224R, Y148I, Y148A, Y148K, Y148F, Y148C, Y148D, Y148E, Y148G, Y148H, Y148K, Y148L, Y148M, Y148N, Y148P, Y148Q, Y148R, Y148S, Y148T, Y148V, Y148W, E508R, and E508K amino acid substitutions. The recombinant polymerase optionally comprises one or more such substitution. Optionally, the C-terminal region of the recombinant polymerase comprises polyhistidine tag, e.g., a His10 tag.

The polymerase can also include mutations at additional positions, for example, at one or more positions selected from the group consisting of D510, E515, F526, N62, D12, D66, K143, E14, H61, D169, Y148, and H149, wherein identification of positions is relative to wild-type Φ29 polymerase (SEQ ID NO:1). For example, the polymerase can include one or more amino acid substitutions selected from the group consisting of D510K, D510Y, D510R, D510H, D510C, E515Q, E515K, E515D, E515H, E515Y, E515C, E515M, E515N, E515P, E515R, E515S, E515T, E515V, E515A, F526L, F526Q, F526V, F526K, F526I, F526A, F526T, F526H, F526M, F526V, and F526Y.

Optionally, the polymerase comprises mutations at two or more, three or more, four or more, five or more, or even six or more of the indicated positions. As a few examples, the polymerase can comprise mutations at positions 375, 512, and 253; positions 375, 512, and 484; positions 375, 512, and 368; positions 375, 512, 253, and 484; or positions 375, 512, 253, 484, and 510.

Exemplary combinations of mutations include E375Y, K512Y, and L253A; E375Y, K512Y, and A484E; E375Y, K512Y, and T368F; L253A, E375Y, A484E, and K512Y; L253A, E375Y, A484E, D510K, and K512Y; Y148I, Y224K, E239G, V250I, L253A, E375Y, A484E, D510K, and K512Y; Y148I, Y224K, E239G, V250I, L253A, E375Y, A484E, D510K, K512Y, and E515Q; E239G, L253A, E375Y, A484E, D510K, and K512Y; Y224K, E239G, L253A, E375Y, A484E, D510K, and K512Y; Y148I, Y224K, E239G, L253C, E375Y, A484E, D510K, and K512Y; N62D, V250I, L253A, E375Y, A484E, and K512Y; Y224K, E239G, L253A, E375Y, A484E, K512Y, and F526L; L253A, E375Y, A484E, K512Y, and E515K; E239G, L253A, E375Y, A484E, E508R, and K512Y; Y148I, L253A, E375Y, A484E, and K512Y; D66R, Y148I, Y224K, E239G, V250I, L253A, E375Y, A484E, D510K, and K512Y; N62D, Y148I, Y224K, E239G, V250I, L253A, E375Y, A484E, D510K, and K512Y; K143R, Y148I, Y224K, E239G, V250I, L253A, E375Y, A484E, D510K, and K512Y; D12N, Y224K, E239G, L253A, E375Y, A484E, and K512Y; Y148F, Y224K, E239G, V250I, L253A, E375Y, A484E, D510K, and K512Y; Y148I, Y224K, E239G, V250I, L253A, E375Y, A484E, D510R, and K512Y; Y148I, Y224K, E239G, V250I, L253A, E375Y, A484E, D510H, and K512Y; and Y148I, Y224K, E239G, V250I, L253A, E375Y, A484E, E508K, D510K, and K512Y.

Additional exemplary combinations of mutations include N62D, L253A, E375Y, A484E and K512Y; N62D, L253A, E375Y and K512Y; N62D, H149M, T368F, E375Y, D510M, K512Y and D523M; N62H, E375Y, A484E, E508R and K512Y; D12R, N62H, T368F, E375Y, A484E and K512Y; D12R, T368F, E375Y, A484E, E508R, 511.1K, 511.2S, 512.1G and 512.2S; D12R, T368F, E375Y, I378W, A484E, E508R, 511.1K, 511.2S, 512.1G and 512.2S; N62D, A190E, E375Y, K422A, A484E, E508R and K512Y; N62D, I93Y, T368F, T372Y, E375Y, I378W, K478Y, A484E, E508R, 511.1K, 511.2S, K512Y, 512.1G and 512.2S; N62D, T368F, E375Y, P477Q, A484E and K512Y; N62D, T368F, E375Y, L384M, A484E and K512Y; T368F, E375Y, P477E and K512Y; A176V, T368F, E375Y and K512Y; T368F, E375Y, K422R and K512Y; N62D, E375Y, P477Q, A484E, K512Y; Y148A, E375Y, A484E and K512Y; N62D, T368F, E375Y and K512Y; T368F, E375Y and K512Y; N62D, T368F, E375Y, A484E and K512Y; I93F, T368F, E375Y, A484E and K512Y; and L253A, E375Y and K512Y.

Additional exemplary mutations and combinations are described herein or can be formed from those disclosed herein, and polymerases including such combinations are also features of the invention.

The recombinant polymerase can be a recombinant Φ29 polymerase. In one class of embodiments, the recombinant polymerase is at least 70% identical to wild-type Φ29 polymerase (SEQ ID NO:1), for example, at least 80%, at least 85%, at least 90%, at least 95%, at least 98%, or even at least 99% identical to wild-type Φ29 polymerase (SEQ ID NO:1). The recombinant polymerase optionally comprises an amino acid sequence selected from SEQ ID NOs:133-193.

In other embodiments, the recombinant polymerase is a recombinant B103, GA-1, PZA, Φ15, BS32, M2Y, Nf, G1, Cp-1, PRD1, PZE, SF5, Cp-5, Cp-7, PR4, PR5, PR722, or L17 polymerase. Thus, for example, the recombinant polymerase can be at least 70% identical to wild-type M2Y polymerase (SEQ ID NO:2), e.g., at least 80%, at least 85%, at least 90%, at least 95%, at least 98%, or even at least 99% identical to wild-type M2Y polymerase (SEQ ID NO:2).

The recombinant polymerase optionally comprises one or more exogenous features at the C-terminal and/or N-terminal region of the polymerase. Exemplary exogenous features include a polyhistidine tag, a His10 tag, a His6 tag, an alanine tag, an Ala10 tag, an Ala16 tag, a biotin ligase recognition sequence, a biotin tag, a GST tag, a BiTag, an S Tag, a SNAP-tag, an HA tag, a DSB (Sso7D) tag, a lysine tag, a NanoTag, a Cmyc tag, a tag or linker comprising the amino acids glycine and serine, a tag or linker comprising the amino acids glycine, serine, alanine and histidine, a tag or linker comprising the amino acids glycine, arginine, lysine, glutamine and proline, a plurality of polyhistidine tags, a plurality of His10 tags, a plurality of His6 tags, a plurality of alanine tags, a plurality of Ala10 tags, a plurality of Ala16 tags, a plurality of biotin tags, a plurality of GST tags, a plurality of BiTags, a plurality of S Tags, a plurality of SNAP-tags, a plurality of HA tags, a plurality of DSB (Sso7D) tags, a plurality of lysine tags, a plurality of NanoTags, a plurality of Cmyc tags, a plurality of tags or linkers comprising the amino acids glycine and serine, a plurality of tags or linkers comprising the amino acids glycine, serine, alanine and histidine, a plurality of tags or linkers comprising the amino acids glycine, arginine, lysine, glutamine and proline, biotin, avidin, one or more Factor Xa sites, one or more enterokinase sites, one or more thrombin sites, one or more antibodies or antibody domains, one or more antibody fragments, one or more antigens, one or more receptors, one or more receptor domains, one or more receptor fragments, one or more ligands, one or more dyes, one or more acceptors, one or more quenchers, and one or more DNA binding domains. The polymerase can also include a combination of such features.

In one class of embodiments, the polymerase comprises one or more exogenous features at the C-terminal region of the polymerase and one or more exogenous features at the N-terminal region of the polymerase. At least one of the one or more exogenous features at the C-terminal and N-terminal region can be the same (for example, the recombinant polymerase can comprise a polyhistidine tag (e.g., a His10 tag) at the C-terminal region and a polyhistidine tag (e.g., a His10 tag) at the N-terminal region of the polymerase), or the features can be different. Optionally, the recombinant polymerase comprises a biotin ligase recognition sequence (e.g., a Btag or variant thereof as described herein) and a polyhistidine tag (e.g., a His10 tag). As a few examples, the polymerase can include a polyhistidine tag at the C-terminal region, a biotin ligase recognition sequence and a polyhistidine tag at the N-terminal region, a biotin ligase recognition sequence and a polyhistidine tag at the N-terminal region and a polyhistidine tag at the C-terminal region, or a polyhistidine tag and a biotin ligase recognition sequence at the C-terminal region.

The composition comprising the recombinant polymerase can also include a nucleotide analog, e.g., a phosphate-labeled nucleotide analog. The analog optionally comprises a fluorophore. The analog can comprise three phosphate groups, or it can comprise four or more phosphate groups, e.g., 4-7 phosphate groups (that is, the analog can be a tetraphosphate, pentaphosphate, hexaphosphate, or septaphosphate analog). In one class of embodiments, the composition includes a nucleotide analog (e.g., a phosphate-labeled nucleotide analog) and a DNA template, and the polymerase incorporates the nucleotide analog into a copy nucleic acid in response to the DNA template. The composition can be present in a DNA sequencing system, e.g., a zero-mode waveguide (ZMW). The recombinant polymerase can be immobilized on a surface, for example, on a surface of a zero-mode waveguide, preferably in an active form.

A related class of embodiments provides methods of making a recombinant polymerase. In the methods, a parental polymerase (e.g., a wild-type or other Φ29-type polymerase) is mutated at positions E375 and K512 and at one or more positions selected from the group consisting of L253, A484, V250, E239, Y224, Y148, E508, and T368, wherein identification of positions is relative to wild-type Φ29 polymerase (SEQ ID NO:1).

Another general class of embodiments provides a composition comprising a recombinant Φ29-type DNA polymerase, which recombinant polymerase comprises one or more mutation selected from the group consisting of an amino acid substitution at position E239, an amino acid substitution at position Y224, an amino acid substitution at position Y148, E239G, Y224K, Y224Q, Y224R, Y148I, Y148A, Y148K, Y148F, Y148C, Y148D, Y148E, Y148G, Y148H, Y148K, Y148L, Y148M, Y148N, Y148P, Y148Q, Y148R, Y148S, Y148T, Y148V, Y148W, L253A, L253C, L253S, A484E, A484Q, A484N, A484D, A484K, E375T, E375C, E375G, E375N, K512I, K512M, K512C, K512G, K512N, K512Q, K512R, K512V, D510K, D510R, D510C, V250I, V250Q, V250L, V250C, V250F, V250N, V250R, V250T, V250Y, E515Q, E515D, E515H, E515Y, E515C, E515M, E515N, E515P, E515R, E515S, E515T, E515V, E515A, E508R, E508K, F526H, F526M, and F526Y, wherein identification of positions is relative to wild-type Φ29 polymerase (SEQ ID NO:1).

The recombinant polymerase can be a recombinant Φ29 polymerase. In one class of embodiments, the recombinant polymerase is at least 70% identical to wild-type Φ29 polymerase (SEQ ID NO:1), for example, at least 80%, at least 85%, at least 90%, at least 95%, at least 98%, or even at least 99% identical to wild-type Φ29 polymerase (SEQ ID NO:1).

In other embodiments, the recombinant polymerase is a recombinant B103, GA-1, PZA, Φ15, BS32, M2Y, Nf, G1, Cp-1, PRD1, PZE, SF5, Cp-5, Cp-7, PR4, PR5, PR722, or L17 polymerase. Thus, for example, the recombinant polymerase can be at least 70% identical to wild-type M2Y polymerase (SEQ ID NO:2), e.g., at least 80%, at least 85%, at least 90%, at least 95%, at least 98%, or even at least 99% identical to wild-type M2Y polymerase (SEQ ID NO:2).

Essentially all of the features noted above apply to these embodiments as well, as relevant, e.g., with respect to mutation of additional positions in the polymerase, inclusion of one or more exogenous features in the polymerase, inclusion of analogs in the composition, immobilization of the polymerase on a surface, inclusion of the composition in a DNA sequencing system, and the like.

Another general class of embodiments provides a composition comprising a recombinant Φ29-type DNA polymerase, which recombinant polymerase comprises a mutation at position A484 and a mutation at position L253, wherein identification of positions is relative to wild-type Φ29 polymerase (SEQ ID NO:1). Optionally, the polymerase comprises one or more amino acid substitutions selected from the group consisting of A484E, L253A, and L253C.

The recombinant polymerase can also include additional mutations. For example, the polymerase can comprise a mutation at one or more positions selected from the group consisting of E375, K512, V250, E239, Y224, Y148, E508, T368, D510, E515, and F526, wherein identification of positions is relative to wild-type Φ29 polymerase (SEQ ID NO:1). Optionally, the polymerase comprises mutations at two or more, three or more, four or more, five or more, or even six or more of these positions.

The recombinant polymerase can be a recombinant Φ29 polymerase. In one class of embodiments, the recombinant polymerase is at least 70% identical to wild-type Φ29 polymerase (SEQ ID NO:1), for example, at least 80%, at least 85%, at least 90%, at least 95%, at least 98%, or even at least 99% identical to wild-type Φ29 polymerase (SEQ ID NO:1).

In other embodiments, the recombinant polymerase is a recombinant B103, GA-1, PZA, Φ15, BS32, M2Y, Nf, G1, Cp-1, PRD1, PZE, SF5, Cp-5, Cp-7, PR4, PR5, PR722, or L17 polymerase. Thus, for example, the recombinant polymerase can be at least 70% identical to wild-type M2Y polymerase (SEQ ID NO:2), e.g., at least 80%, at least 85%, at least 90%, at least 95%, at least 98%, or even at least 99% identical to wild-type M2Y polymerase (SEQ ID NO:2).

Essentially all of the features noted above apply to these embodiments as well, as relevant, e.g., with respect to mutation of additional positions in the polymerase, exemplary substitutions, exemplary combinations of mutations, inclusion of one or more exogenous features in the polymerase, inclusion of analogs in the composition, immobilization of the polymerase on a surface, inclusion of the composition in a DNA sequencing system, and the like.

In one aspect, the invention provides methods of sequencing a DNA template. In the methods, a reaction mixture that includes the DNA template, a replication initiating moiety that complexes with or is integral to the template, one or more nucleotides and/or nucleotide analogs, and a recombinant polymerase of the invention (e.g., a recombinant Φ29-type DNA polymerase) is provided. The polymerase is capable of replicating at least a portion of the template using the moiety in a template-dependent polymerization reaction. The reaction mixture is subjected to a polymerization reaction in which the recombinant polymerase replicates at least a portion of the template in a template-dependent manner, whereby the one or more nucleotides and/or nucleotide analogs are incorporated into the resulting DNA. A time sequence of incorporation of the one or more nucleotides and/or nucleotide analogs into the resulting DNA is identified.

The nucleotide analogs used in the methods can comprise a first analog and a second analog (and optionally third, fourth, etc.), each of which comprise different fluorescent labels. The different fluorescent labels can optionally be distinguished from one another during the step in which a time sequence of incorporation is identified. Optionally, subjecting the reaction mixture to a polymerization reaction and identifying a time sequence of incorporation are performed in a zero mode waveguide.

In a related aspect, the invention provides methods of making a DNA. In the methods, a reaction mixture is provided that includes a template, a replication initiating moiety that complexes with or is integral to the template, one or more nucleotides and/or nucleotide analogs, and a recombinant polymerase of the invention (e.g., a recombinant Φ29-type DNA polymerase). The polymerase is capable of replicating at least a portion of the template using the moiety in a template-dependent polymerase reaction. The mixture is reacted such that the polymerase replicates at least a portion of the template in a template-dependent manner, whereby the one or more nucleotides and/or nucleotide analogs are incorporated into the resulting DNA. The reaction mixture is optionally reacted in a zero mode waveguide. The methods optionally include detecting incorporation of at least one of the nucleotides and/or nucleotide analogs.

BRIEF DESCRIPTION OF THE DRAWINGS

FIG. 15 shows the results of a stopped-flow experiment for a polymerase reaction system in which the decrease in the fluorescent signal fits to a single exponential and the increase in signal fits to a single exponential.

FIG. 34 provides exemplary polymerase mutations (e.g., substitutions, deletions, and insertions) and combinations thereof, relative to a wild-type Φ29 DNA polymerase, in accordance with the invention.

FIG. 35 provides exemplary polymerase mutations and combinations thereof in accordance with the invention. Positions are identified relative to wild-type Φ29 DNA polymerase.

FIG. 43 presents an alignment between the amino acid sequences of wild-type M2Y polymerase (SEQ ID NO:2) and wild-type Φ29 polymerase (SEQ ID NO:1).

DEFINITIONS

Figure 1B:
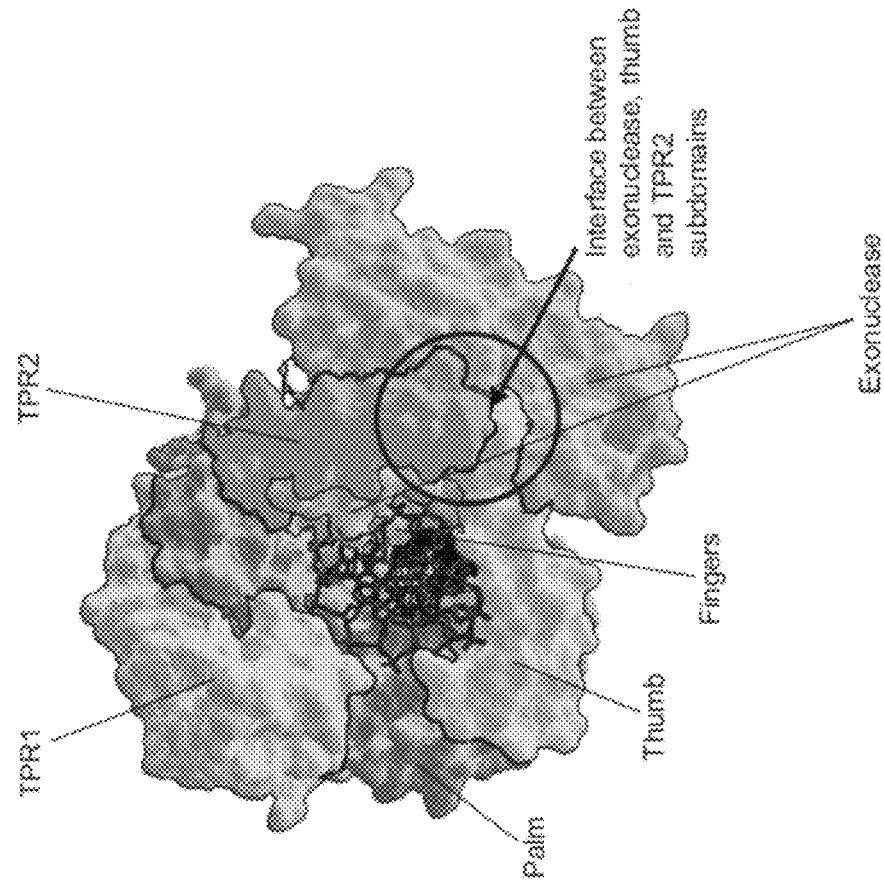
FIG. 1 Panels A and B depict a closed Φ29 polymerase/DNA complex.

Unless defined otherwise, all technical and scientific terms used herein have the same meaning as commonly understood by one of ordinary skill in the art to which the invention pertains. The following definitions supplement those in the art and are directed to the current application and are not to be imputed to any related or unrelated case, e.g., to any commonly owned patent or application. Although any methods and materials similar or equivalent to those described herein can be used in the practice for testing of the present invention, the preferred materials and methods are described herein. Accordingly, the terminology used herein is for the purpose of describing particular embodiments only, and is not intended to be limiting.

As used in this specification and the appended claims, the singular forms "a," "an" and "the" include plural referents unless the context clearly dictates otherwise. Thus, for example, reference to "a protein" includes a plurality of proteins; reference to "a cell" includes mixtures of cells, and the like.

The term "about" as used herein indicates the value of a given quantity varies by +/−10% of the value, or optionally +/−5% of the value, or in some embodiments, by +/−1% of the value so described.

The term "nucleic acid" or "polynucleotide" encompasses any physical string of monomer units that can be corresponded to a string of nucleotides, including a polymer of nucleotides (e.g., a typical DNA or RNA polymer), PNAs, modified oligonucleotides (e.g., oligonucleotides comprising nucleotides that are not typical to biological RNA or DNA, such as 2'-O-methylated oligonucleotides), and the like. A nucleic acid can be e.g., single-stranded or double-stranded. Unless otherwise indicated, a particular nucleic acid sequence of this invention encompasses complementary sequences, in addition to the sequence explicitly indicated.

A "polypeptide" is a polymer comprising two or more amino acid residues (e.g., a peptide or a protein). The polymer can additionally comprise non-amino acid elements such as labels, quenchers, blocking groups, or the like and can optionally comprise modifications such as glycosylation or the like. The amino acid residues of the polypeptide can be natural or non-natural and can be unsubstituted, unmodified, substituted or modified.

An "amino acid sequence" is a polymer of amino acid residues (a protein, polypeptide, etc.) or a character string representing an amino acid polymer, depending on context.

A "polynucleotide sequence" or "nucleotide sequence" is a polymer of nucleotides (an oligonucleotide, a DNA, a nucleic acid, etc.) or a character string representing a nucleotide polymer, depending on context. From any specified polynucleotide sequence, either the given nucleic acid or the complementary polynucleotide sequence (e.g., the complementary nucleic acid) can be determined.

Numbering of a given amino acid or nucleotide polymer "corresponds to numbering of" or is "relative to" a selected amino acid polymer or nucleic acid when the position of any given polymer component (amino acid residue, incorporated nucleotide, etc.) is designated by reference to the same residue position in the selected amino acid or nucleotide polymer, rather than by the actual position of the component in the given polymer. Similarly, identification of a given position within a given amino acid or nucleotide polymer is "relative to" a selected amino acid or nucleotide polymer when the position of any given polymer component (amino acid residue, incorporated nucleotide, etc.) is designated by reference to the residue name and position in the selected amino acid or nucleotide polymer, rather than by the actual name and position of the component in the given polymer. Correspondence of positions is typically determined by aligning the relevant amino acid or polynucleotide sequences. For example, residue K221 of wild-type M2Y polymerase (SEQ ID NO:2) is identified as position Y224 relative to wild-type Φ29 polymerase (SEQ ID NO:1); see, e.g., the alignment shown in FIG. 43.

The term "recombinant" indicates that the material (e.g., a nucleic acid or a protein) has been artificially or synthetically (non-naturally) altered by human intervention. The alteration can be performed on the material within, or removed from, its natural environment or state. For example, a "recombinant nucleic acid" is one that is made by recombining nucleic acids, e.g., during cloning, DNA shuffling or other procedures, or by chemical or other mutagenesis; a "recombinant polypeptide" or "recombinant protein" is, e.g., a polypeptide or protein which is produced by expression of a recombinant nucleic acid.

A "Φ29-type DNA polymerase" (or "phi29-type DNA polymerase") is a DNA polymerase from the Φ29 phage or from one of the related phages that, like Φ29, contain a terminal protein used in the initiation of DNA replication. Φ29-type DNA polymerases are homologous to the Φ29 DNA polymerase (e.g., as listed in SEQ ID NO:1); examples include the B103, GA-1, PZA, Φ15, BS32, M2Y (also known as M2), Nf, G1, Cp-1, PRD1, PZE, SF5, Cp-5, Cp-7, PR4, PR5, PR722, L17, and AV-1 DNA polymerases, as well as chimeras thereof. A modified recombinant Φ29-type DNA polymerase includes one or more mutations relative to naturally-occurring wild-type Φ29-type DNA polymerases, for example, one or more mutations that increase closed complex stability, decrease branching fraction, slow a catalytic step relative to a corresponding wild-type polymerase, and/or alter another polymerase property, and may include additional alterations or modifications over the wild-type Φ29-type DNA polymerase, such as one or more deletions, insertions, and/or fusions of additional peptide or protein sequences (e.g., for immobilizing the polymerase on a surface or otherwise tagging the polymerase enzyme).

A variety of additional terms are defined or otherwise characterized herein.

DETAILED DESCRIPTION

One aspect of the invention is generally directed to compositions comprising a recombinant polymerase, e.g., a recombinant Φ29-type DNA polymerase, that includes one or more mutations as compared to a reference polymerase, e.g., a wild-type Φ29-type polymerase. Depending on the particular mutation or combination of mutations, the polymerase exhibits one or more properties that find use in, e.g., single molecule sequencing applications. Exemplary properties exhibited by various polymerases of the invention include a reduction in the rate of one or more steps of the polymerase kinetic cycle (resulting from, e.g., enhanced interaction of the polymerase with nucleotide analog, enhanced metal coordination, and other features described in detail below), increased closed complex stability, an altered branching fraction, reduced or eliminated exonuclease activity, altered cofactor selectivity, and increased processivity, yield, thermostability, accuracy, speed, and/or readlength, as well as other features that will become apparent upon a complete review of the present disclosure. The polymerases can include one or more exogenous or heterologous features at the N- and/or C-terminal regions of the polymerase. Such features find use not only for purification of the recombinant polymerase and/or immobilization of the polymerase to a substrate, but can also alter one or more properties of the polymerase.

Among other aspects, the present invention provides new polymerases that incorporate nucleotide analogs, such as dye labeled phosphate labeled analogs, into a growing template copy during DNA amplification. These polymerases are modified such that they have one or more desirable properties, for example, decreased branching fraction formation when incorporating the relevant analogs, improved DNA-polymerase stability or processivity, reduced exonuclease activity, increased thermostability and/or yield, altered cofactor selectivity, improved accuracy, speed, and/or readlength, and/or altered kinetic properties as compared to corresponding wild-type or other parental polymerases (e.g., polymerases from which modified recombinant polymerases of the invention were derived, e.g., by mutation). The polymerases of the invention can also include any of the additional features for improved specificity, improved processivity, improved retention time, improved surface stability, affinity tagging, and/or the like noted herein.

These new polymerases are particularly well suited to DNA amplification and/or sequencing applications, particularly sequencing protocols that include detection in real time of the incorporation of labeled analogs into DNA amplicons, since the altered rates, reduced or eliminated exonuclease activity, decreased branch fraction, improved complex stability, altered metal cofactor selectivity, or the like can facilitate discrimination of nucleotide incorporation events from non-incorporation events such as transient binding of a mismatched nucleotide in the active site of the complex, improve processivity, and/or facilitate detection of incorporation events.

Polymerases of the invention include, for example, a recombinant Φ29-type DNA polymerase that comprises a mutation at one or more positions selected from the group consisting of E375, K512, L253, A484, V250, E239, Y224, Y148, E508, T368, D510, E515, F526, N62, D12, D66, and K143, where identification of positions is relative to wild-type Φ29 polymerase (SEQ ID NO:1). Optionally, the polymerase comprises mutations at two or more, three or more, four or more, five or more, or even six or more of these positions. For example, the polymerase can include a mutation at position E375, a mutation at position K512, and a mutation at one or more positions selected from the group consisting of L253, A484, V250, E239, Y224, Y148, E508, and T368, and can optionally also include a mutation at one or more of positions D510, E515, F526, N62, D12, D66, and K143. As a few examples, the polymerase can comprise mutations at positions 375, 512, and 253; positions 375, 512, and 484; positions 375, 512, and 368; positions 375, 512, 253, and 484; or positions 375, 512, 253, 484, and 510. As another example, the polymerase can comprise a mutation at position A484 and a mutation at position L253. A number of exemplary substitutions at these (and other) positions are described herein.

The polymerase mutations and mutational strategies noted herein can be combined with each other and with essentially any other available mutations and mutational strategies to confer additional improvements in, e.g., nucleotide analog specificity, enzyme processivity, improved retention time of labeled nucleotides in polymerase-DNA-nucleotide complexes, and the like. For example, the mutations and mutational strategies herein can be combined with those taught in, e.g., WO 2007/076057 POLYMERASES FOR NUCLEOTIDE ANALOGUE INCORPORATION by Hanzel et al., WO 2008/051530 POLYMERASE ENZYMES AND REAGENTS FOR ENHANCED NUCLEIC ACID SEQUENCING by Rank et al., and U.S. patent application Ser. No. 12/584,481 filed Sep. 4, 2009, by Pranav Patel et al. entitled "ENGINEERING POLYMERASES AND REACTION CONDITIONS FOR MODIFIED INCORPORATION PROPERTIES." This combination of mutations/mutational strategies can be used to impart several simultaneous improvements to a polymerase (e.g., decreased branch fraction formation, improved specificity, improved processivity, altered rates, improved retention time, improved stability of the closed complex, tolerance for a particularly preferred metal cofactor, etc.). In addition, polymerases can be further modified for application-specific reasons, such as to increase photostability, e.g., as taught in U.S. patent application Ser. No. 12/384,110 filed Mar. 30, 2009, by Keith Bjornson et al. entitled "Enzymes Resistant to Photodamage," to improve activity of the enzyme when bound to a surface, as taught, e.g., in WO 2007/075987 ACTIVE SURFACE COUPLED POLYMERASES by Hanzel et al. and WO 2007/076057 PROTEIN ENGINEERING STRATEGIES TO OPTIMIZE ACTIVITY OF SURFACE ATTACHED PROTEINS by Hanzel et al., or to include purification or handling tags as is taught in the cited references and as is common in the art. Similarly, the modified polymerases described herein can be employed in combination with other strategies to improve polymerase performance, for example, reaction conditions for controlling polymerase rate constants such as taught in U.S. patent application Ser. No. 12/414,191 filed Mar. 30, 2009, and entitled "Two slow-step polymerase enzyme systems and methods," incorporated herein by reference in its entirety for all purposes.

Also taught are approaches for modifying polymerases to enhance one or more properties exhibited by the polymerases, or to confer an additional property not provided by a starting combination of mutations. For example, provided below are approaches for structure-based design of additional polymerase functionalities or activities, approaches for determining the kinetic parameters or other properties of modified recombinant polymerases of the invention, and screening methods (including high-throughput screening methods) for identifying polymerases with the one or more desired properties.

DNA Polymerases

DNA polymerases that can be modified to have reduced reaction rates, reduced or eliminated exonuclease activity, decreased branch fraction, improved complex stability, altered metal cofactor selectivity, and/or other desirable properties as described herein are generally available. DNA polymerases are sometimes classified into six main groups based upon various phylogenetic relationships, e.g., with *E. coli* Pol I (class A), *E. coli* Pol II (class B), *E. coli* Pol III (class C), Euryarchaeotic Pol II (class D), human Pol beta (class X), and *E. coli* UmuC/DinB and eukaryotic RAD30/xeroderma pigmentosum variant (class Y). For a review of recent nomenclature, see, e.g., Burgers et al. (2001) "Eukaryotic DNA polymerases: proposal for a revised nomenclature" J Biol. Chem. 276(47):43487-90. For a review of polymerases, see, e.g., Hübscher et al. (2002) "Eukaryotic DNA Polymerases" Annual Review of Biochemistry Vol. 71: 133-163; Alba (2001) "Protein Family Review: Replicative DNA Polymerases" Genome Biology 2(1): reviews 3002.1-3002.4; and Steitz (1999) "DNA polymerases: structural diversity and common mechanisms" J Biol Chem 274:17395-17398. The basic mechanisms of action for many polymerases have been determined. The sequences of literally hundreds of polymerases are publicly available, and the crystal structures for many of these have been determined or can be inferred based upon similarity to solved crystal structures for homologous polymerases. For example, the crystal structure of Φ29, a preferred type of parental enzyme to be modified according to the invention, is available.

In addition to wild-type polymerases, chimeric polymerases made from a mosaic of different sources can be used. For example, Φ29-type polymerases made by taking sequences from more than one parental polymerase into account can be used as a starting point for mutation to produce the polymerases of the invention. Chimeras can be produced, e.g., using consideration of similarity regions between the polymerases to define consensus sequences that are used in the chimera, or using gene shuffling technologies in which multiple Φ29-related polymerases are randomly or semi-randomly shuffled via available gene shuffling techniques (e.g., via "family gene shuffling"; see Crameri et al. (1998) "DNA shuffling of a family of genes from diverse species accelerates directed evolution" Nature 391:288-291; Clackson et al. (1991) "Making antibody fragments using phage display libraries" Nature 352:624-628; Gibbs et al. (2001) "Degenerate oligonucleotide gene shuffling (DOGS): a method for enhancing the frequency of recombination with family shuffling" Gene 271:13-20; and Hiraga and Arnold (2003) "General method for sequence-independent site-directed chimeragenesis: J. Mol. Biol. 330:287-296). In these methods, the recombination points can be predetermined such that the gene fragments assemble in the correct order. However, the combinations, e.g., chimeras, can be formed at random. For example, using methods described in Clarkson et al., five gene chimeras, e.g., comprising segments of a Phi29 polymerase, a PZA polymerase, a M2 polymerase, a B103 polymerase, and a GA-1 polymerase, can be generated. Appropriate mutations to improve branching fraction, increase closed complex stability, or alter reaction rate constants or another desirable property can be introduced into the chimeras.

Available DNA polymerase enzymes have also been modified in any of a variety of ways, e.g., to reduce or eliminate exonuclease activities (many native DNA polymerases have a proof-reading exonuclease function that interferes with, e.g., sequencing applications), to simplify production by making protease digested enzyme fragments such as the Klenow fragment recombinant, etc. As noted, polymerases have also been modified to confer improvements in specificity, processivity, and retention time of labeled nucleotides in polymerase-DNA-nucleotide complexes (e.g., WO 2007/076057 POLYMERASES FOR NUCLEOTIDE ANALOGUE INCORPORATION by Hanzel et al. and WO 2008/051530 POLYMERASE ENZYMES AND REAGENTS FOR ENHANCED NUCLEIC ACID SEQUENCING by Rank et al.), to alter branching fraction and translocation (e.g., U.S. patent application Ser. No. 12/584,481 filed Sep. 4, 2009, by Pranav Patel et al. entitled "ENGINEERING POLYMERASES AND REACTION CONDITIONS FOR MODIFIED INCORPORATION PROPERTIES"), to increase photostability (e.g., U.S. patent application Ser. No. 12/384,110 filed Mar. 30, 2009, by Keith Bjornson et al. entitled "Enzymes Resistant to Photodamage"), and to improve surface-immobilized enzyme activities (e.g., WO 2007/075987 ACTIVE SURFACE COUPLED POLYMERASES by Hanzel et al. and WO 2007/076057 PROTEIN ENGINEERING STRATEGIES TO OPTIMIZE ACTIVITY OF SURFACE ATTACHED PROTEINS by Hanzel et al.). Any of these available polymerases can be modified in accordance with the invention.

Many such polymerases that are suitable for modification are available, e.g., for use in sequencing, labeling, and amplification technologies. For example, human DNA Polymerase Beta is available from R&D systems. DNA polymerase I is available from Epicenter, GE Health Care, Invitrogen, New England Biolabs, Promega, Roche Applied Science, Sigma Aldrich, and many others. The Klenow fragment of DNA Polymerase I is available in both recombinant and protease digested versions, from, e.g., Ambion, Chimerx, eEnzyme LLC, GE Health Care, Invitrogen, New England Biolabs, Promega, Roche Applied Science, Sigma Aldrich and many others. Φ29 DNA polymerase is available from e.g., Epicentre. Poly A polymerase, reverse transcriptase, Sequenase, SP6 DNA polymerase, T4 DNA polymerase, T7 DNA polymerase, and a variety of thermostable DNA polymerases (Taq, hot start, titanium Taq, etc.) are available from a variety of these and other sources. Recent commercial DNA polymerases include Phusion™ High-Fidelity DNA Polymerase, available from New England Biolabs; GoTaq® Flexi DNA Polymerase, available from Promega; RepliPHI™ Φ29 DNA Polymerase, available from Epicentre Biotechnologies; PfuUltra™ Hotstart DNA Polymerase, available from Stratagene; KOD HiFi DNA Polymerase, available from Novagen; and many others. Biocompare(dot)com provides comparisons of many different commercially available polymerases.

DNA polymerases that are preferred substrates for mutation to reduce reaction rates, reduce or eliminate exonuclease activity, decrease branching fraction, improve closed complex stability, alter metal cofactor selectivity, and/or alter one or more other property described herein include Taq polymerases, exonuclease deficient Taq polymerases, *E. coli* DNA Polymerase 1, Klenow fragment, reverse transcriptases, Φ29 related polymerases including wild type Φ29 polymerase and derivatives of such polymerases such as exonuclease deficient forms, T7 DNA polymerase, T5 DNA polymerase, RB69 polymerase, etc.

In one aspect, the polymerase that is modified is a Φ29-type DNA polymerase. For example, the modified recombinant DNA polymerase can be homologous to a wild-type or exonuclease deficient Φ29 DNA polymerase, e.g., as described in U.S. Pat. Nos. 5,001,050, 5,198,543, or 5,576,204. Alternately, the modified recombinant DNA polymerase can be homologous to other Φ29-type DNA polymerases, such as B103, GA-1, PZA, Φ15, BS32, M2Y (also known as M2), Nf, G1, Cp-1, PRD1, PZE, SF5, Cp-5, Cp-7, PR4, PR5, PR722, L17, AV-1, Φ21, or the like. For nomenclature, see also, Meijer et al. (2001) "Φ29 Family of Phages" Microbiology and Molecular Biology Reviews, 65(2):261-287. See, e.g., SEQ ID NO:1 for the amino acid sequence of wild-type Φ29 polymerase, SEQ ID NO:2 for the amino acid sequence of wild-type M2Y polymerase, SEQ ID NO:3 for the amino acid sequence of wild-type B103 polymerase, SEQ ID NO:4 for the amino acid sequence of wild-type GA-1 polymerase, SEQ ID NO:5 for the amino acid sequence of wild-type AV-1 polymerase, and SEQ ID NO:6 for the amino acid sequence of wild-type CP-1 polymerase.

Nucleotide Analogs

As discussed, various polymerases of the invention can incorporate one or more nucleotide analogs into a growing oligonucleotide chain. Upon incorporation, the analog can leave a residue that is the same as or different than a natural nucleotide in the growing oligonucleotide (the polymerase can incorporate any non-standard moiety of the analog, or can cleave it off during incorporation into the oligonucleotide). A "nucleotide analog" herein is a compound, that, in a particular application, functions in a manner similar or analogous to a naturally occurring nucleoside triphosphate (a "nucleotide"), and does not otherwise denote any particular structure. A nucleotide analog is an analog other than a standard naturally occurring nucleotide, i.e., other than A, G, C, T, or U, though upon incorporation into the oligonucleotide, the resulting residue in the oligonucleotide can be the same as (or different from) an A, G, C, T, or U residue.

In one useful aspect of the invention, nucleotide analogs can also be modified to achieve any of the improved properties desired. For example, various linkers or other substituents can be incorporated into analogs that have the effect of reducing branching fraction, improving processivity, or altering rates. Modifications to the analogs can include extending the phosphate chains, e.g., to include a tetra-, penta-, hexa- or heptaphosphate group, and/or adding chemical linkers to extend the distance between the nucleotide base and the dye molecule, e.g., a fluorescent dye molecule. Substitution of one or more non-bridging oxygen in the polyphosphate, for example with S or $BH_3$, can change the polymerase reaction kinetics, e.g., to achieve a system having two slow steps as described hereinbelow. Optionally, one or more, two or more, three or more, or four or more non-bridging oxygen atoms in the polyphosphate group of the analog has an S substituted for an O. While not being bound by theory, it is believed that the properties of the nucleotide, such as the metal chelation properties, electronegativity, or steric properties, can be altered by substitution of the non-bridging oxygen(s).

Many nucleotide analogs are available and can be incorporated by the polymerases of the invention. These include analog structures with core similarity to naturally occurring nucleotides, such as those that comprise one or more substituent on a phosphate, sugar, or base moiety of the nucleoside or nucleotide relative to a naturally occurring nucleoside or nucleotide. In one embodiment, the nucleotide analog includes three phosphate containing groups; for example, the analog can be a labeled nucleoside triphosphate analog and/or an α-thiophosphate nucleotide analog having three phosphate groups. In one embodiment, a nucleotide analog can include one or more extra phosphate containing groups, relative to a nucleoside triphosphate. For example, a variety of nucleotide analogs that comprise, e.g., from 4-6 or more phosphates are described in detail in U.S. patent application Ser. No. 11/241,809, filed Sep. 29, 2005, and incorporated herein by reference in its entirety for all purposes. Other exemplary useful analogs, including tetraphosphate and pentaphosphate analogs, are described in U.S. Pat. No. 7,041,812, incorporated herein by reference in its entirety for all purposes.

For example, the analog can include a labeled compound of the formula:

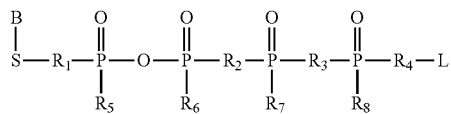

wherein B is a nucleobase (and optionally includes a label); S is selected from a sugar moiety, an acyclic moiety or a carbocyclic moiety (and optionally includes a label); L is an optional detectable label; $R_1$ is selected from O and S; $R_2$, $R_3$ and $R_4$ are independently selected from O, NH, S, methylene, substituted methylene, C(O), C(CH$_2$), CNH$_2$, CH$_2$CH$_2$, C(OH)CH$_2$R where R is 4-pyridine or 1-imidazole, provided that $R_4$ may additionally be selected from

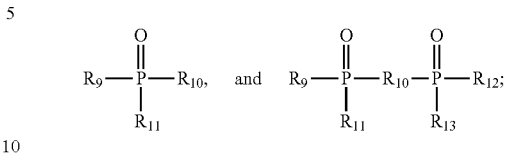

$R_5$, $R_6$, $R_7$, $R_8$, $R_{11}$ and $R_{13}$ are, when present, each independently selected from O, $BH_3$, and S; and $R_9$, $R_{10}$ and $R_{12}$ are independently selected from O, NH, S, methylene, substituted methylene, CNH$_2$, CH$_2$CH$_2$, and C(OH)CH$_2$R where R is 4-pyridine or 1-imidazole. In some cases, phosphonate analogs may be employed as the analogs, e.g., where one of $R_2$, $R_3$, $R_4$, $R_9$, $R_{10}$ or $R_{12}$ are not O, e.g., they are methyl etc. See, e.g., U.S. patent application Ser. No. 11/241,809, previously incorporated herein by reference in its entirety for all purposes.

The base moiety incorporated into the analog is generally selected from any of the natural or non-natural nucleobases or nucleobase analogs, including, e.g., purine or pyrimidine bases that are routinely found in nucleic acids and available nucleic acid analogs, including adenine, thymine, guanine, cytidine, uracil, and in some cases, inosine. As noted, the base optionally includes a label moiety. For convenience, nucleotides and nucleotide analogs are generally referred to based upon their relative analogy to naturally occurring nucleotides. As such, an analog that operates, functionally, like adenosine triphosphate, may be generally referred to herein by the shorthand letter A. Likewise, the standard abbreviations of T, G, C, U and I, may be used in referring to analogs of naturally occurring nucleosides and nucleotides typically abbreviated in the same fashion. In some cases, a base may function in a more universal fashion, e.g., functioning like any of the purine bases in being able to hybridize with any pyrimidine base, or vice versa. The base moieties used in the present invention may include the conventional bases described herein or they may include such bases substituted at one or more side groups, or other fluorescent bases or base analogs, such as 1,N6 ethenoadenosine or pyrrolo C, in which an additional ring structure renders the B group neither a purine nor a pyrimidine. For example, in certain cases, it may be desirable to substitute one or more side groups of the base moiety with a labeling group or a component of a labeling group, such as one of a donor or acceptor fluorophore, or other labeling group. Examples of labeled nucleobases and processes for labeling such groups are described in, e.g., U.S. Pat. Nos. 5,328,824 and 5,476,928, each of which is incorporated herein by reference in its entirety for all purposes.

In the analogs, the S group is optionally a sugar moiety that provides a suitable backbone for a synthesizing nucleic acid strand. For example, the sugar moiety is optionally selected from a D-ribosyl, 2' or 3' D-deoxyribosyl, 2',3'-D-dideoxyribosyl, 2',3'-D-didehydrodideoxyribosyl, 2' or 3' alkoxyribosyl, 2' or 3' aminoribosyl, 2' or 3' mercaptoribosyl, 2' or 3' alkothioribosyl, acyclic, carbocyclic or other modified sugar moieties. A variety of carbocyclic or acyclic moieties can be incorporated as the "S" group in place of a sugar moiety, including, e.g., those described in U.S. Patent Application Publication No. 2003/0124576, which is incorporated herein by reference in its entirety for all purposes.

For most cases, the phosphorus containing chain in the analogs, e.g., a triphosphate in conventional NTPs, is preferably coupled to the 5' hydroxyl group, as in natural nucleoside triphosphates. However, in some cases, the phosphorus containing chain is linked to the S group by the 3' hydroxyl group.

L generally refers to a detectable labeling group that is coupled to the terminal phosphorus atom via the $R_4$ (or $R_{10}$ or $R_{12}$ etc.) group. The labeling groups employed in the analogs of the invention may comprise any of a variety of detectable labels. Detectable labels generally denote a chemical moiety that provides a basis for detection of the analog compound separate and apart from the same compound lacking such a labeling group. Examples of labels include, e.g., optical labels, e.g., labels that impart a detectable optical property to the analog, electrochemical labels, e.g., labels that impart a detectable electrical or electrochemical property to the analog, and physical labels, e.g., labels that impart a different physical or spatial property to the analog, e.g., a mass tag or molecular volume tag. In some cases individual labels or combinations may be used that impart more than one of the aforementioned properties to the analogs of the invention.

Optionally, the labeling groups incorporated into the analogs comprise optically detectable moieties, such as luminescent, chemiluminescent, fluorescent, fluorogenic, chromophoric and/or chromogenic moieties, with fluorescent and/or fluorogenic labels being preferred. A variety of different label moieties are readily employed in nucleotide analogs. Such groups include fluorescein labels, rhodamine labels, cyanine labels (i.e., Cy3, Cy5, and the like, generally available from the Amersham Biosciences division of GE Healthcare), the Alexa family of fluorescent dyes and other fluorescent and fluorogenic dyes available from Molecular Probes/Invitrogen, Inc. and described in 'The Handbook—A Guide to Fluorescent Probes and Labeling Technologies, Tenth Edition' (2005) (available from Invitrogen, Inc./Molecular Probes). A variety of other fluorescent and fluorogenic labels for use with nucleoside polyphosphates, and which would be applicable to the nucleotide analogs incorporated by the polymerases of the present invention, are described in, e.g., U.S. Patent Application Publication No. 2003/0124576, previously incorporated herein by reference in its entirety for all purposes.

Additional details regarding analogs and methods of making such analogs can be found in U.S. patent application Ser. No. 11/241,809, filed Sep. 29, 2005, and incorporated herein by reference in its entirety for all purposes.

Thus, in one illustrative example, the analog can be a phosphate analog (e.g., an analog that has more than the typical number of phosphates found in nucleoside triphosphates) that includes, e.g., an Alexa dye label. For example, an Alexa488 dye can be labeled on a delta phosphate of a tetraphosphate analog (denoted, e.g., A488dC4P or A488dA4P, shown in FIG. 3, for the Alexa488 labeled tetraphosphate analogs of C and A, respectively), or an Alexa568 or Alexa633 dye can be used (e.g., A568dC4P and A633dC4P, respectively, for labeled tetraphosphate analogs of C or A568dT6P for a labeled hexaphosphate analog of T), or an Alexa546 dye can be used (e.g., A546dG4P), or an Alexa594 dye can be used (e.g., A594dT4P). As additional examples, an Alexa555 dye (e.g., A555dC6P or A555dA6P), an Alexa 647 dye (e.g., A647dG6P), an Alexa 568 dye (e.g., A568dT6P), and/or an Alexa660 dye (e.g., A660dA6P or A660dC6P) can be used in, e.g., single molecule sequencing. Similarly, to facilitate color separation, a pair of fluorophores exhibiting FRET (fluorescence resonance energy transfer) can be labeled on a delta phosphate of a tetraphosphate analog (denoted, e.g., FAM-amb-A532dG4P or FAM-amb-A594dT4P).

Applications for Enhanced Nucleic Acid Amplification and Sequencing

Polymerases of the invention, e.g., modified recombinant polymerases, are optionally used in combination with nucleotides and/or nucleotide analogs and nucleic acid templates (DNA or RNA) to copy the template nucleic acid. That is, a mixture of the polymerase, nucleotides/analogs, and optionally other appropriate reagents, the template and a replication initiating moiety (e.g., primer) is reacted such that the polymerase synthesizes nucleic acid (e.g., extends the primer) in a template-dependent manner. The replication initiating moiety can be a standard oligonucleotide primer, or, alternatively, a component of the template, e.g., the template can be a self-priming single stranded DNA, a nicked double stranded DNA, or the like. Similarly, a terminal protein can serve as an initiating moiety. At least one nucleotide analog can be incorporated into the DNA. The template DNA can be a linear or circular DNA, and in certain applications, is desirably a circular template (e.g., for rolling circle replication or for sequencing of circular templates). Optionally, the composition can be present in an automated DNA replication and/or sequencing system.

Incorporation of labeled nucleotide analogs by the polymerases of the invention is particularly useful in a variety of different nucleic acid analyses, including real-time monitoring of DNA polymerization. The label can itself be incorporated, or more preferably, can be released during incorporation of the analog. For example, analog incorporation can be monitored in real-time by monitoring label release during incorporation of the analog by the polymerase. The portion of the analog that is incorporated can be the same as a natural nucleotide, or can include features of the analog that differ from a natural nucleotide.

In general, label incorporation or release can be used to indicate the presence and composition of a growing nucleic acid strand, e.g., providing evidence of template replication/amplification and/or sequence of the template. Signaling from the incorporation can be the result of detecting labeling groups that are liberated from the incorporated analog, e.g., in a solid phase assay, or can arise upon the incorporation reaction. For example, in the case of FRET labels where a bound label is quenched and a free label is not, release of a label group from the incorporated analog can give rise to a fluorescent signal. Alternatively, the enzyme may be labeled with one member of a FRET pair proximal to the active site, and incorporation of an analog bearing the other member will allow energy transfer upon incorporation. The use of enzyme bound FRET components in nucleic acid sequencing applications is described, e.g., in U.S. Patent Application Publication No. 2003/0044781, incorporated herein by reference.

In one example reaction of interest, a polymerase reaction can be isolated within an extremely small observation volume that effectively results in observation of individual polymerase molecules. As a result, the incorporation event provides observation of an incorporating nucleotide analog that is readily distinguishable from non-incorporated nucleotide analogs. In a preferred aspect, such small observation volumes are provided by immobilizing the polymerase enzyme within an optical confinement, such as a Zero Mode Waveguide (ZMW). For a description of ZMWs and their application in single molecule analyses, and particularly nucleic acid sequencing, see, e.g., U.S. Patent Application Publication No. 2003/0044781, and U.S. Pat. No. 6,917,726, each of which is incorporated herein by reference in its entirety for all purposes. See also Levene et al. (2003) "Zero-mode waveguides for single-molecule analysis at high concentrations" Science 299:682-686, Eid et al. (2009) "Real-time DNA sequencing from single polymerase molecules" Science 323:133-138, and U.S. Pat. Nos. 7,056,676, 7,056,661, 7,052,847, and 7,033,764, the full disclosures of which are incorporated herein by reference in their entirety for all purposes.

In general, a polymerase enzyme is complexed with the template strand in the presence of one or more nucleotides and/or one or more nucleotide analogs. For example, in certain embodiments, labeled analogs are present representing analogous compounds to each of the four natural nucleotides, A, T, G and C, e.g., in separate polymerase reactions, as in classical Sanger sequencing, or multiplexed together, e.g., in a single reaction, as in multiplexed sequencing approaches. When a particular base in the template strand is encountered by the polymerase during the polymerization reaction, it complexes with an available analog that is complementary to such nucleotide, and incorporates that analog into the nascent and growing nucleic acid strand. In one aspect, incorporation can result in a label being released, e.g., in polyphosphate analogs, cleaving between the $\alpha$ and $\beta$ phosphorus atoms in the analog, and consequently releasing the labeling group (or a portion thereof). The incorporation event is detected, either by virtue of a longer presence of the analog and, thus, the label, in the complex, or by virtue of release of the label group into the surrounding medium. Where different labeling groups are used for each of the types of analogs, e.g., A, T, G or C, identification of a label of an incorporated analog allows identification of that analog and consequently, determination of the complementary nucleotide in the template strand being processed at that time. Sequential reaction and monitoring permits real-time monitoring of the polymerization reaction and determination of the sequence of the template nucleic acid. As noted above, in particularly preferred aspects, the polymerase enzyme/template complex is provided immobilized within an optical confinement that permits observation of an individual complex, e.g., a zero mode waveguide. For additional information on single molecule sequencing monitoring incorporation of phosphate-labeled analogs in real time, see, e.g., Eid et al. (2009) "Real-time DNA sequencing from single polymerase molecules" Science 323:133-138.

In addition to their use in sequencing, the polymerases of the invention are also useful in a variety of other genotyping analyses, e.g., SNP genotyping using single base extension methods, real time monitoring of amplification, e.g., RT-PCR methods, and the like. Further details regarding sequencing and nucleic acid amplification can be found, e.g., in Sambrook, Ausubel, and Innis, all infra.

Recombinant Polymerases with Desirable Properties for Single Molecule Sequencing The compositions of the invention comprise a modified recombinant DNA polymerase which exhibits one or more altered properties (e.g., kinetic or other properties) desirable in single molecule sequencing applications. An exemplary property of certain polymerases of the invention is one or more slow catalytic steps during the polymerase kinetic cycle relative to a wild-type or parental polymerase. The one or more slow catalytic steps can be achieved by introducing one or more functionalities into the polymerase, e.g., enhanced metal coordination, closed conformation stabilization, enhanced or destabilized interactions with certain portions of a nucleotide or nucleotide analog (e.g., the base, a phosphate group, or a label on an analog), altered polyphosphate release, slower polymerase translocation, and/or strengthened or weakened interactions with the phosphate tail of a nucleotide analog. Other exemplary properties include exonuclease deficiency, increased closed complex stability, altered (e.g., reduced) branching fraction, altered cofactor selectivity, increased yield, increased thermostability, increased accuracy, increased speed, and increased readlength.

As will be understood, polymerases of the invention can display one of the aforementioned properties alone or can display two or more of the properties in combination. Moreover, it will be understood that while a polymerase or group of polymerases may be described with respect to a particular property, the polymerase(s) may possess additional modified properties not mentioned in every instance for ease of discussion. A single mutation (e.g., a single amino acid substitution, deletion, insertion, or the like) may give rise to the one or more altered properties, or the one or more properties may result from two or more mutations which act in concert to confer the desired activity. The recombinant polymerases, mutations, and altered properties exhibited by the recombinant polymerases are set forth in greater detail below.

A. Modified Recombinant Polymerases with Slow Steps

In one aspect, the invention features recombinant polymerases with modifications that decrease the rate of one or more steps within the catalytic cycle, for example, to achieve a reaction system having two kinetically observable reaction steps within an observable phase of the polymerase reaction. As described in greater detail below, such systems can be useful for observing the activity of a polymerase enzyme in real time, for example, for carrying out single molecule nucleic acid sequencing. For example, a system in which the reaction kinetics exhibit two slow steps within an observable phase can result in more observable sequencing events, allowing for a more accurate determination of a nucleic acid sequence.

In single molecule DNA sequencing by synthesis, for example as described in Eid et al. (2009) Science 323(5910): 133-138, the incorporation of specific nucleotides can be determined by observing bright phases and dark phases which correspond, for example, to reaction steps in which a fluorescent label is associated with the polymerase enzyme and steps in which the fluorescent label is not associated with the enzyme, respectively. In some embodiments of the invention, the polymerase reaction system will exhibit two sequential slow (kinetically observable) reaction steps wherein each of the steps is in a bright phase. In some embodiments of the invention, the system will exhibit two sequential slow reaction steps wherein each of the steps is in a dark phase. In some embodiments, the system will have four slow reaction steps, two slow steps in a bright phase and two slow steps in a dark phase. In some cases, the two or more slow steps are consecutive. In some cases, there can be intervening fast steps between the two or more slow steps.

Figure 44:
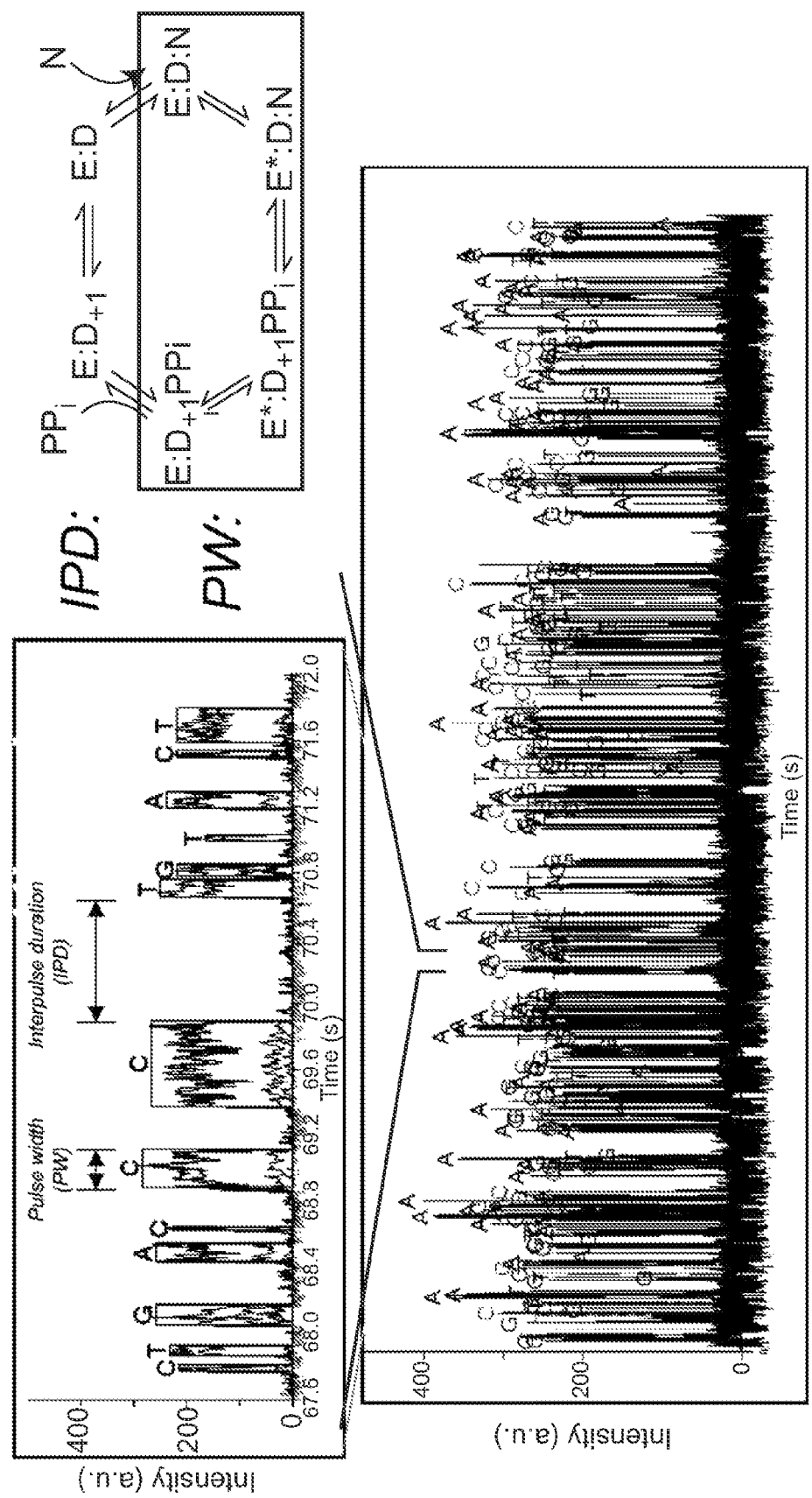
FIG. 44 presents a fluorescence time trace for a ZMW, showing pulses representing incorporation of different nucleotide analogs. A pulse width and interpulse distance are illustrated on the trace. The inset schematically illustrates the catalytic cycle for polymerase-mediated extension; the box indicates the portion of the catalytic cycle that corresponds to the pulse when sequencing is performed with phosphate-labeled nucleotide analogs. The remainder of the cycle corresponds to the interpulse distance.

An observable phase will generally have a time period during which it is observable. The time period for a bright phase, for example, can be represented by the pulse width. The time period for a dark phase can be represented, for example, by the interpulse distance. (Pulse width and interpulse distance are illustrated, e.g., in FIG. 44.) The length of each time period will not be the same for each nucleotide addition, resulting in a distribution of the length of the time periods. In some cases, the time periods with the shortest length will not be detected, leading to errors in single molecule sequencing. By designing polymerase reaction systems in which there are two slow, or kinetically observable, steps within an observable phase, the relative number of short, unobservable, time periods can be reduced, resulting in a higher proportion of observable sequencing events and allowing for a more accurate determination of nucleotide sequence. For example, having two slow steps within a bright phase can reduce the incidence of very short pulses, while having two slow steps within a dark phase can reduce the incidence of very short interpulse distances (which occasionally cause pulse merging).

The modified recombinant polymerases with decreased reaction rates described hereinbelow are desirably employed to obtain such a system with two (or more) slow reaction steps. Optionally, the polymerase reaction conditions, including the type and levels of cofactors and/or the reaction substrates are also manipulated to achieve such a system, as described in U.S. patent application Ser. No. 12/414,191 filed Mar. 30, 2009, and entitled "Two slow-step polymerase enzyme systems and methods."

Polymerase Mediated Synthesis

In natural polymerase mediated nucleic acid synthesis, a complex is formed between a polymerase enzyme, a template nucleic acid sequence, and a priming sequence that serves as the point of initiation of the synthetic process. During synthesis, the polymerase samples nucleotide monomers from the reaction mix to determine their complementarity to the next base in the template sequence. When the sampled base is complementary to the next base, it is incorporated into the growing nascent strand. This process continues along the length of the template sequence to effectively duplicate that template. Although described in a simplified schematic fashion, the actual biochemical process of incorporation is relatively complex.

The process can be described as a sequence of steps, wherein each step can be characterized as having a particular forward and reverse reaction rate that can be represented by a rate constant. One representation of the incorporation biochemistry is provided in FIG. 12. It is to be understood that the scheme shown in FIG. 12 does not provide a unique representation of the process. In some cases, the process can be described using fewer steps. For example, the process is sometimes represented without inclusion of the enzyme isomerization steps 106 and 110. Alternatively, the process can be represented by including additional steps such as cofactor binding. Generally, steps which can be slow, and thus limit the rate of reaction, will tend to be included. Various schemes can be used to represent a polymerization reaction, e.g., having one or two slow steps, that may have more or fewer identified steps.

Figure 12:
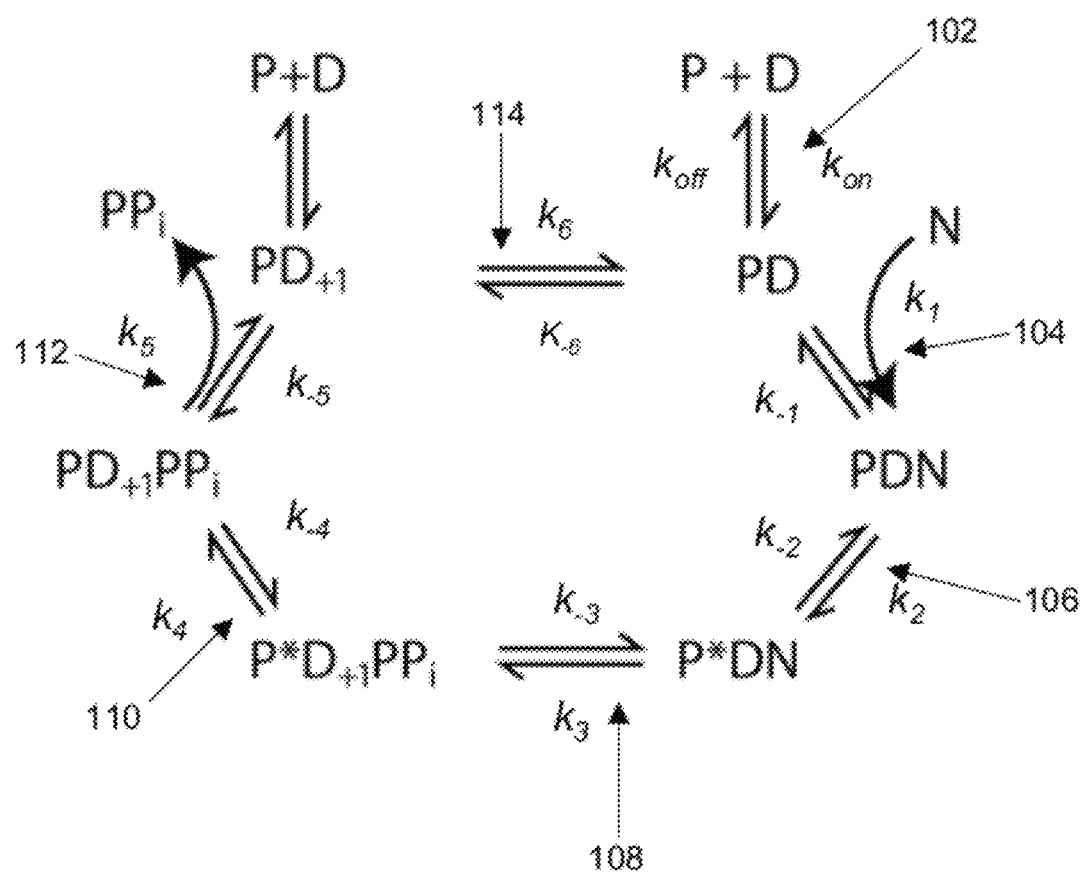
FIG. 12 schematically illustrates the catalytic cycle for polymerase-mediated nucleic acid primer extension.

As shown in FIG. 12, the synthesis process begins with the binding of the primed nucleic acid template (D) to the polymerase (P) at step 102. Nucleotide (N) binding with the complex occurs at step 104. Step 106 represents the isomerization of the polymerase from the open to closed configuration. Step 108 is the chemistry step where the nucleotide is incorporated into the growing strand of the nucleic acid being synthesized. At step 110, polymerase isomerization occurs from the closed to the open position. The polyphosphate component that is cleaved upon incorporation is released from the complex at step 112. The polymerase then translocates on the template at step 114. As shown, the various steps can include reversible paths and may be characterized by the reaction constants shown in FIG. 12 where:

$k_{on}/k_{off}$=DNA binding/release;
$k_1/k_{-1}$=nucleotide binding/release;
$k_2/k_{-2}$=polymerase isomerization (open/closed);
$k_3/k_{-3}$=nucleotide incorporation (chemistry);
$k_4/k_{-4}$=polymerase isomerization (closed/open);
$k_5/k_{-5}$=polyphosphate release/binding;
$k_6/k_{-6}$=polymerase translocation.

Thus, during steps 104 through 110, the nucleotide is retained within the overall complex, and during steps 104 and 106, reversal of the reaction step will yield an unproductive event, i.e., not resulting in incorporation. For example, a bound nucleotide at step 104 may be released regardless of whether it is the correct nucleotide for incorporation.

By selecting the appropriate polymerase enzyme, polymerase reaction conditions, and polymerase substrates, the absolute and relative rates of the various steps can be controlled. Controlling the reaction such that the reaction exhibits two or more sequential kinetically observable, or slow, steps can produce a nucleic acid polymerization reaction in which the incorporation of the nucleotides can be observed more accurately. These characteristics are particularly useful for sequencing applications, and in particular single molecule DNA sequencing.

In some cases, the invention involves a process having two or more slow steps that comprise steps after nucleotide binding through the step of product release. For the mechanism shown in FIG. 12, this would be, for example, any of steps 106, 108, 110, and 112. In some cases, steps 108 (nucleotide incorporation) and 112 (product release) are the two slow steps. In some cases, the invention involves a process having two or more slow steps that comprise the steps after product release through nucleotide binding. For the mechanism shown in FIG. 12, this would include steps 114 and 104.

In some cases, the invention involves a process in which there are two or more slow steps in two different observable phases within the polymerization, for example, two slow steps in a bright phase and two slow steps in a dark phase. For example, this could include a system having two slow steps in the steps after nucleotide binding through product release, and two slow steps for the steps after product release through nucleotide binding. As is described herein, producing a process in which there are two slow steps in these portions of the polymerase reaction can result in a higher proportion of detectable enzyme states which can be useful, for example, to observe the sequential incorporation of nucleotides for nucleotide sequencing.

By the term slow step is generally meant a kinetically observable step. An enzymatic process, such as nucleic acid polymerization, can have both slower, kinetically observable steps and faster steps which are so fast that they have no measurable effect on the kinetics, or rate, of the reaction. In some reactions, there can be a single rate limiting step. For such reactions, the kinetics can be characterized by the rate of that single step. Other reactions will not have a single rate limiting step, but will have two or more steps which are close enough in rate such that the characteristics of each will contribute to the kinetics of the reaction. For the current invention, the slow, or kinetically observable, steps need not be the slowest step or the rate limiting step of the reaction. For example, a process of the current invention can involve a reaction in which step 104, nucleotide addition, is the slowest (rate limiting) step, while two or more of steps 106, 108, 110, or 112 are each kinetically observable.

As used herein, the term rate as applied to the steps of a reaction can refer to the average rate of reaction. For example, when observing a single molecule reaction, there will generally be variations in the rates as each individual nucleotide is added to a growing nucleic acid. In such cases the rate of the reaction can be represented by observing a number of individual events, and combining the rates, for example, by obtaining an average of the rates.

As used herein, the reference to the rate of a step or rate constant for a step can refer to the forward reaction rate of the polymerase reaction. As is generally understood in the art, reaction steps can be characterized as having forward and reverse rate constants. For example, for step 108, $k_3$ represents the forward rate constant, and $k_{-3}$ represents the reverse rate constant for the nucleotide incorporation. Some reaction steps, such as step 108, constitute steps which would be expected to be first order steps. Other steps, such as the forward reaction of step 104, with rate constant $k_2$, would be expected to be second order rate constants. For the purposes of the invention, for comparing the rate or the rate constant of a first order to a second order step, the second order rate constant $k_2$ can be treated as a pseudo-first order rate constant with the value $[N]*k_2$ where the concentration of nucleotide [N] is known.

For some applications, it is desirable that the kinetically observable steps of the invention have rate constants that are lower than about 100 per second. In some cases, the rate constants are lower than about 60 per second, lower than about 50 per second, lower than about 30 per second, lower than about 20 per second, lower than about 10 per second, lower than about 5 per second, lower than about 2 per second, or lower than about 1 per second.

In some embodiments the slowest of the two or more kinetically observable steps has a rate constant when measured under single molecule conditions of between about 60 to about 0.5 per second, about 30 per second to about 2 per second, or about 10 to about 3 per second.

The ratio of the rate constants of each the two or more slow steps is generally greater than 1:10; in some cases the ratio of the rate constants is about 1:5, in some cases the ratio of the rate constants is about 1:2, and in some cases, the ratio of rate constants is about 1:1. The ratio of the rate constants can be between about 1:10 and about 1:1, between about 1:5 and about 1:1, or between about 1:2 and about 1:1.

In some cases it is useful to consider the two slow-step system in terms of rates rather than rate constants. It is generally desirable that the kinetically observable steps of the invention have rates that are lower than about 100 molecules per second when the reactions are carried out under single-molecule conditions. In some cases, the rates are lower than about 60 molecules per second, lower than about 50 molecules per second, lower than about 30 molecules per second, lower than about 20 molecules per second, lower than about 10 molecules per second, lower than about 5 molecules per second, lower than about 2 molecules per second, or lower than about 1 molecule per second.

In some embodiments the slowest of the two or more kinetically observable steps has a rate when measured under single molecule conditions of between about 60 to about 0.5 molecules per second, about 30 molecules per second to about 2 molecules per second, or about 10 to about 3 molecules per second.

The ratio of the rates of each the two or more slow steps is generally greater than 1:10. In some cases the ratio of the rates is about 1:5, in some cases the ratio of the rates is about 1:2, and in some cases, the ratio of rates is about 1:1. The ratio can be between about 1:10 and about 1:1, between about 1:5 and about 1:1, or between about 1:2 and about 1:1.

Any one (or more) of the steps described above is optionally slowed in the recombinant polymerases of the invention, e.g., to produce a polymerase useful in achieving a reaction system exhibiting two slow steps.

Sequencing by Incorporation

For sequencing processes that rely upon monitoring of the incorporation of nucleotides into growing nascent strands being synthesized by the complex, the progress of the reaction through these steps is of significant importance. In particular, for certain "real time" nucleotide incorporation monitoring processes, the detectability of the incorporation event is improved based upon the amount of time the nucleotide is incorporated into and retained within the synthesis complex during its ultimate incorporation into a primer extension product.

By way of example, in certain exemplary processes, the presence of the nucleotide in the synthesis complex is detected either by virtue of a focused observation of the synthesis complex, or through the use of interactive labeling techniques that produce characteristic signals when the nucleotide is within the synthesis complex. See, e.g., Levene et al. (2003) Science 299:682-686 and Eid et al. (2009) Science 323(5910):133-138, the full disclosures of which are incorporated herein by reference in their entirety for all purposes.

Figure 13A:
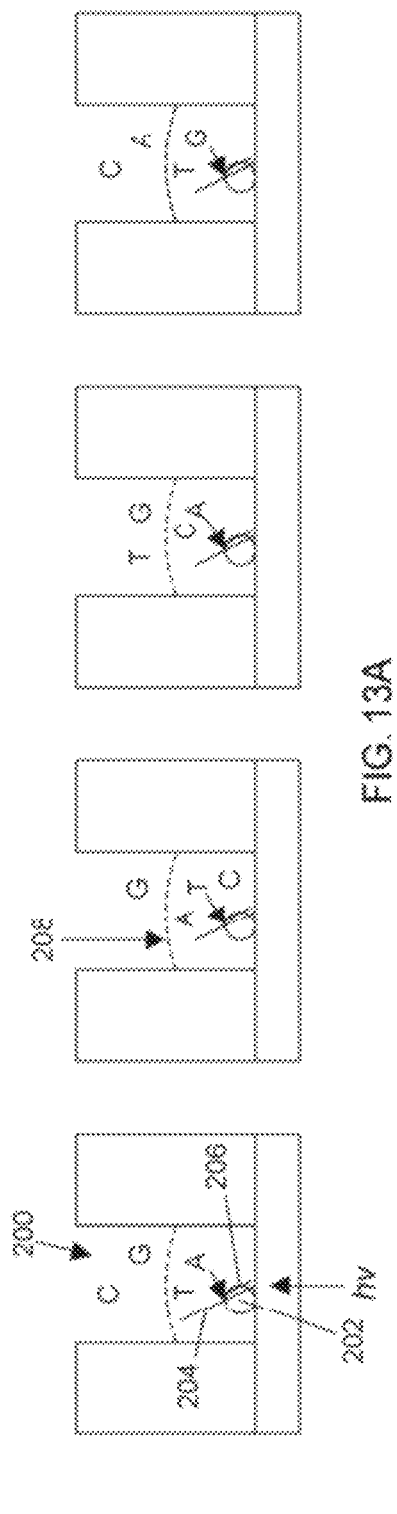
FIG. 13 Panels A and B schematically illustrate an exemplary single molecule sequencing by incorporation process in which the compositions of the invention provide particular advantages.
Figure 13B:
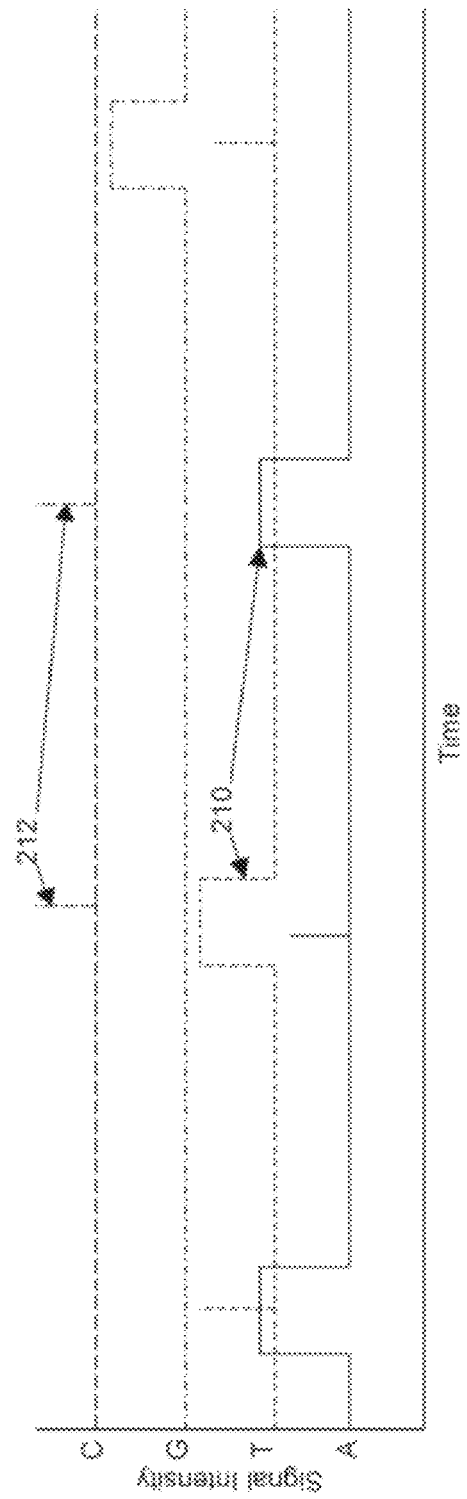

In a first exemplary technique, as schematically illustrated in FIG. 13 Panel A, a nucleic acid synthesis complex, including a polymerase enzyme 202, a template sequence 204 and a complementary primer sequence 206, is provided immobilized within an observation region 200 that permits illumination (as shown by hv) and observation of a small volume that includes the complex without excessive illumination of the surrounding volume (as illustrated by dashed line 208). By illuminating and observing only the volume immediately surrounding the complex, one can readily identify fluorescently labeled nucleotides that become incorporated during that synthesis, as such nucleotides are retained within that observation volume by the polymerase for longer periods than those nucleotides that are simply randomly diffusing into and out of that volume.

In particular, as shown in Panel B of FIG. 13, when a nucleotide, e.g., A, is incorporated into by the polymerase, it is retained within the observation volume for a prolonged period of time, and upon continued illumination yields a prolonged fluorescent signal (shown by peak 210). By comparison, randomly diffusing and not incorporated nucleotides remain within the observation volume for much shorter periods of time, and thus produce only transient signals (such as peak 212), many of which go undetected, due to their extremely short duration.

In particularly preferred exemplary systems, the confined illumination volume is provided through the use of arrays of optically confined apertures termed zero mode waveguides (ZMWs), e.g., as shown by confined reaction region 200 (see, e.g., U.S. Pat. No. 6,917,726, which is incorporated herein by reference in its entirety for all purposes). For sequencing applications, the DNA polymerase is typically provided immobilized upon the bottom of the ZMW. See, e.g., Korlach et al. (2008) PNAS U.S.A. 105(4):1176-1181, which is incorporated herein by reference in its entirety for all purposes.

In operation, the fluorescently labeled nucleotides (shown as A, C, G and T) bear one or more fluorescent dye groups on a terminal phosphate moiety that is cleaved from the nucleotide upon incorporation. As a result, synthesized nucleic acids do not bear the build-up of fluorescent labels, as the labeled polyphosphate groups diffuse away from the complex following incorporation of the associated nucleotide, nor do such labels interfere with the incorporation event. See, e.g., Korlach et al. (2008) Nucleosides, Nucleotides and Nucleic Acids 27:1072-1083.

In a second exemplary technique, the immobilized complex and the nucleotides to be incorporated are each provided with interactive labeling components. Upon incorporation, the nucleotide borne labeling component is brought into sufficient proximity to the complex borne (or complex proximal) labeling component, such that these components produce a characteristic signal event. For example, the polymerase may be provided with a fluorophore that provides fluorescent resonant energy transfer (FRET) to appropriate acceptor fluorophores. These acceptor fluorophores are provided upon the nucleotide to be incorporated, where each type of nucleotide bears a different acceptor fluorophore, e.g., that provides a different fluorescent signal. Upon incorporation, the donor and acceptor are brought close enough together to generate energy transfer signal. By providing different acceptor labels on the different types of nucleotides, one obtains a characteristic FRET-based fluorescent signal for the incorporation of each type of nucleotide, as the incorporation is occurring.

In a related aspect, a nucleotide analog may include two interacting fluorophores that operate as a donor/quencher pair, where one member is present on the nucleobase or other retained portion of the nucleotide, while the other member is present on a phosphate group or other portion of the nucleotide that is released upon incorporation, e.g., a terminal phosphate group. Prior to incorporation, the donor and quencher are sufficiently proximal on the same analog as to provide characteristic signal quenching. Upon incorporation and cleavage of the terminal phosphate groups, e.g., bearing a donor fluorophore, the quenching is removed and the resulting characteristic fluorescent signal of the donor is observable.

In exploiting the foregoing processes, where the incorporation reaction occurs too rapidly, it may result in the incorporation event not being detected, i.e., the event speed exceeds the detection speed of the monitoring system. The missed detection of incorporated nucleotides can lead to an increased rate of errors in sequence determination, as omissions in the real sequence. In order to mitigate the potential for missed pulses due to short reaction times, in one aspect, the current invention can result in increased reaction time for incorporations. An advantage of employing polymerases with reduced reaction rates, e.g., polymerases exhibiting decreased rates and/or two slow-step kinetics, is an increased frequency of longer, detectable, binding events. This advantage may also be seen as an increased ratio of longer, detectable pulses to shorter, non-detectable pulses, where the pulses represent binding events.

Single molecule sequencing often involves the optical observation of the polymerase process during the process of nucleotide incorporation, for example, observation of the enzyme-DNA complex. During this process, there are generally two or more observable phases. For example, where a terminal-phosphate labeled nucleotide is used and the enzyme-DNA complex is observed, there is a bright phase during the steps where the label is incorporated with (bound to) the polymerase enzyme, and a dark phase where the label is not incorporated with the enzyme. For the purposes of this invention, both the dark phase and the bright phase are generally referred to as observable phases, because the characteristics of these phases can be observed.

Whether a phase of the polymerase reaction is bright or dark can depend, for example, upon how and where the components of the reaction are labeled and also upon how the reaction is observed. For example, as described above, the phase of the polymerase reaction where the nucleotide is bound can be bright where the nucleotide is labeled on its terminal phosphate. However, where there is a quenching dye associated with the enzyme or template, the bound state may be quenched, and therefore be a dark phase. Analogously, in a ZMW, the release of the terminal phosphate may result in a dark phase, whereas in other systems, the release of the terminal phosphate may be observable, and therefore constitute a bright phase.

For example, consider again the reaction scheme of FIG. 12 in the context of the sequencing by incorporation embodiment described above which utilizes nucleotides having labels on their terminal phosphates. For this system, intermediates PDN, P*DN, P*D$_{+1}$PP$_i$ and PD$_{+1}$PP$_i$ would all represent bright states of a bright phase because for each of these intermediates, the label is associated with the polymerase enzyme. In contrast, intermediates PD$_{+1}$ and PD correspond to dark states of a dark phase, because for these intermediates, no dye is associated with the polymerase enzyme. In one aspect of the invention, any step (and preferably any two of the steps) which proceed from a bright intermediate, e.g. steps 106, 108, 110, and 112 of FIG. 12 are slow. By having two or more sequential bright steps that are slow, the relative number of longer pulses and detectable incorporation events increases.

Another example of a polymerase reaction with distinct observable phases is one in which the nucleotide is labeled such that its label does not dissociate from the enzyme upon product release, for example where the nucleotide is labeled on the base or on the sugar moiety. Here, the phase in which the label is associated with the active site of the enzyme (bright or dark) may extend past product release until translocation. For this example, an observable phase may extend from nucleotide binding until translocation.

In addition, the systems of the present invention may have two or more different distinct bright phases, for example, phases that can be distinguished based on different colors, e.g. different fluorescent emission wavelengths in the different observable phases. For all of these cases, it can be advantageous to have more than one rate limiting (kinetically observable) step within a phase. Having more than one rate limiting step within a phase can result in a distribution of pulse widths having relatively fewer undetectable or poorly detectable short pulses.

Figure 14:
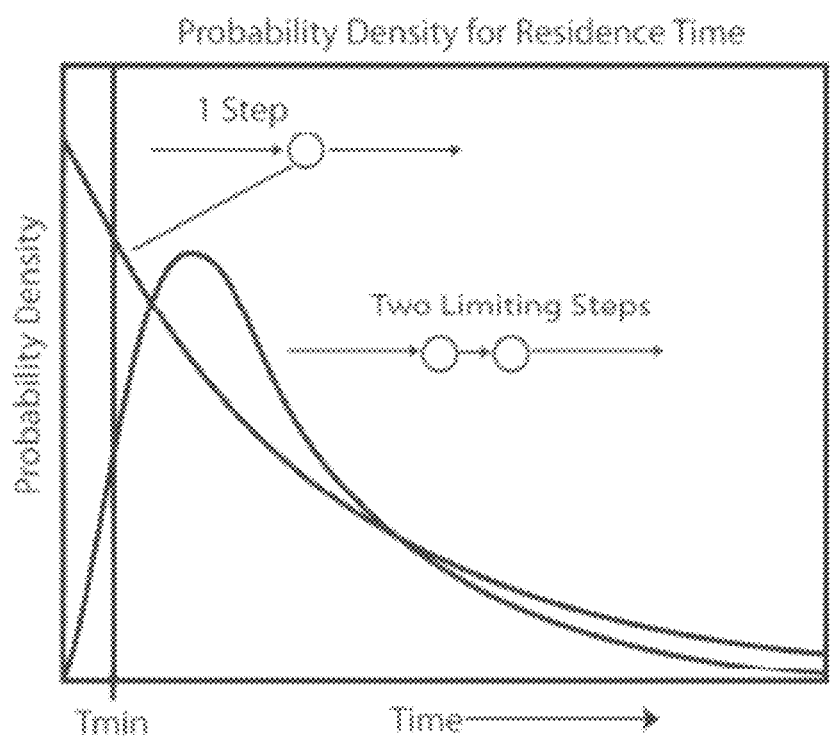
FIG. 14 shows a theoretical representation of the probability density for residence time for a polymerase reaction having one rate limiting step or two rate limiting steps within an observable phase.

While not being bound by theory, the following theoretical basis is provided for obtaining improved single molecule sequencing results by using a system having two or more slow steps. A model for the effect of two slow steps on the probability density for residence time is described herein. FIG. 14 shows a plot of calculated probability density for residence time for cases in which (1) one step is rate limiting and (2) two equivalent rate limiting (slow) steps are present for the observable phase in which the nucleotide is associated with the enzyme.

For the case in which one step is rate limiting, the probability distribution for the binding time can be represented by the single exponential equation:

$$y = A_0 e^{-kt} \qquad \text{Eq. 1}$$

This represents the case in which, for example, incorporation of nucleotide into the growing nucleic acid (step 108 in FIG. 12) is the single slow step.

FIG. 14 illustrates that where one slow step is present in this phase, there is an exponentially decreasing probability of a given residence time as the residence time increases, providing a distribution in which there is a relatively high probability that the residence time will be short.

For the case in which there are two slow steps in this phase, for example where both the incorporation step (step 108 in FIG. 12) and the release of product (PPi) step (step 112 in FIG. 12) are slow, the probability density versus residence time can be represented by a double exponential equation:

$$y = A_0 e^{-k_1 t} - B_0 e^{-k_2 t} \qquad \text{Eq. 2}$$

FIG. 14 illustrates that for the case in where there are two slow steps, the probability of very fast residence times is relatively low as compared to the case having one slow step. In addition, the probability distribution for two slow steps exhibits a peak in the plot of probability density versus residence time. This type of residence time distribution can be advantageous for single molecule sequencing where it is desired to measure a high proportion of binding events and where fast binding events may be unreliably detected.

Typically, for a given illumination/detection system there will be a minimum detection time below which events, such as binding events, will be unreliably detected or not detected at all. This minimum detection time can be attributed, for example, to the frame acquisition time or frame rate of the optical detector, for example, a CCD camera. A discussion of detection times and approaches to detection for these types of systems is provided in U.S. patent application Ser. No. 12/351,173 the full disclosure of which is incorporated herein by reference in its entirety for all purposes. FIG. 14 includes a line which indicates a point where the residence time equals a minimum detection time (Tmin). The area under the curve in the region below Tmin represents the population of short pulses which will not be accurately detected for this system. It can be seen from FIG. 14 that the relative proportion of binding times that fall below Tmin is significantly lower for the case in which the reaction exhibits two sequential slow steps as compared to the case where the reaction exhibits one slow step.

Thus, as described above, one aspect of the invention relates to methods, systems, and compositions for performing nucleic acid sequencing with a nucleic acid synthesis reaction in which the reaction exhibits two or more slow steps within a bright phase, e.g., employing a modified polymerase exhibiting one or more slowed step. In addition, an aspect of the invention relates to nucleic acid synthesis reactions having two or more slow states wherein each of the slow steps proceeds from a state in which the labeled component is associated with the polymerase enzyme.

In some embodiments of the invention, the two or more slow steps are within a dark phase. In some cases the two or more slow steps proceed from states in which the labeled component is not associated with the enzyme. Having two or more slow states that proceed from a dark intermediate can be advantageous, for example, for lowering the frequency of events having a very short dark state or having a very short interpulse distance. The advantage of this type of system can be demonstrated by again considering FIG. 12 in the context of the sequencing by incorporation embodiment described above which utilizes nucleotides having labels on their terminal phosphates. In this system, intermediates $PD_{+1}$ and PD can correspond to dark states within a dark phase, for example in a ZMW, because for these intermediates, no dye is associated with the polymerase enzyme.

The steps that comprise the two slow steps can include, for example, nucleotide addition, enzymatic isomerization such as to or from a closed state, cofactor binding or release, product release, incorporation of nucleic acid into the growing nucleic acid, or translocation. As noted, one or more of the slow steps can be achieved by modification of the polymerase. Various exemplary modified recombinant polymerases exhibiting one or more slow steps are described herein, along with strategies for producing additional such polymerases.

Modified Recombinant Polymerases Exhibiting Slow Steps

The invention features recombinant polymerases with modifications that slow one or more steps in the catalytic cycle, for example, to achieve two limiting steps as described above. Accordingly, one aspect of the invention provides a modified recombinant DNA polymerase that comprises one or more mutations relative to a parental polymerase and that exhibits a first rate constant for a first step in its catalytic cycle that is less than a first rate constant for the first step exhibited by the parental polymerase. For example, the first rate constant exhibited by the modified recombinant polymerase can be less than 0.5 times, less than 0.25 times, or even less than 0.1 times the first rate constant exhibited by the parental polymerase.

As noted above, to achieve a two slow step enzyme it is typically desirable to decrease the rate of a step which is not already rate limiting. Thus, in one aspect, the first step is not rate limiting in the catalytic cycle of the parental polymerase. Also as noted above, polymerases exhibiting approximately the same rate for two sequential (though not necessarily consecutive) steps are desirable. Thus, the modified recombinant polymerase optionally exhibits a second rate constant for a second step in its catalytic cycle, where the second rate constant is between 0.1 and 10 times the first rate constant. Preferably, the second rate constant exhibited by the modified recombinant polymerase is between 0.2 and 5 times the first rate constant exhibited by the modified recombinant polymerase. More preferably, the second rate constant exhibited by the modified recombinant polymerase is approximately equal to the first rate constant exhibited by the modified recombinant polymerase (e.g., within 10%, 5%, or 1%). In one exemplary embodiment, the second step involves incorporation of a bound nucleotide or nucleotide analog, the first step involves release of a polyphosphate product, and the second rate constant exhibited by the modified recombinant polymerase is between 0.2 and 1 times the first rate constant exhibited by the modified recombinant polymerase. In another exemplary embodiment, the first step involves translocation and the second step involves nucleotide or analog binding. It will be understood that in this context, the terms first step and second step are merely used for convenience in referring to two different steps and do not imply any particular order of occurrence (that is, the first step can precede or follow the second and need not be the initial event in the catalytic pathway).

Optionally, the second step is rate limiting in the catalytic cycle of the parental polymerase. The first or second step can be rate limiting in the catalytic cycle of the modified polymerase. As another option, however, the first and/or second steps are not rate limiting for the catalytic cycle, but are limiting for a portion of the cycle (e.g., the bright or dark portion). Optionally, the polymerase exhibits two limiting steps in the bright portion of the cycle and two in the dark portion.

Since for many polymerases nucleotide incorporation is rate limiting, the second step can, for example, involve incorporation of a bound nucleotide or nucleotide analog, e.g., an analog having from 3-7 phosphate groups, e.g., with a terminal label. The second rate constant would then be $k_3$ according to the catalytic cycle illustrated in FIG. 12.

Essentially any step in the cycle can correspond to the first step whose rate is slowed, for example, nucleotide or analog binding, translocation, isomerization, e.g., of the polymerase or analog, chemistry (incorporation or transphosphorylation), pre-product release isomerization, and product release. Optionally, an extra kinetic step is created that does not occur in the parental enzyme's cycle. In one exemplary class of useful embodiments, the first step involves release of a polyphosphate product, including, for example (and depending on the type of nucleotide or analog incorporated), a pyrophosphate, a polyphosphate with three or more phosphate groups, a labeled polyphosphate, etc. Polyphosphate release is typically so fast as to be undetectable by routine techniques, but in the polymerases of the invention release can be sufficiently slowed as to be observable and permit determination of a rate constant (e.g., $k_5$). Accordingly, the first rate constant exhibited by a modified recombinant polymerase for release of polyphosphate can be less than 100/second, less than 75/second, or even less than 50/second.

The parental and modified polymerases can display comparable rates for the second step, or the second step can also be slowed for the recombinant polymerase. Thus, the second rate constant exhibited by the modified recombinant polymerase is optionally smaller than the second rate constant exhibited by the parental polymerase for the second step, e.g., less than 0.5 times, less than 0.25 times, or even less than 0.1 times the second rate constant exhibited by the parental polymerase.

A modified polymerase (e.g., a modified recombinant Φ29-type DNA polymerase) that exhibits one or more slow steps optionally includes a mutation (e.g., an amino acid substitution or insertion) at one or more of positions 484, 249, 179, 198, 211, 255, 259, 360, 363, 365, 370, 372, 378, 381, 383, 387, 389, 393, 433, 478, 480, 514, 251, 371, 379, 380, 383, 458, 486, 101, 188, 189, 303, 313, 395, 414, 497, 500, 531, 532, 534, 558, 570, 572, 574, 64, 305, 392, 402, 422, 496, 529, 538, 555, 575, 254, 390, 372-397, 507-514, 93, 129, 170, 176, 180, 181, 182, 185, 190, 203, 204, 247, 329, 330, 361, 399, 420, 427, 436, 459, 477, 487, and 567, or any other position where a mutation is noted herein, where numbering of positions is relative to wild-type Φ29 polymerase. For example, relative to wild-type Φ29 a modified recombinant polymerase can include at least one amino acid substitution or combination of substitutions selected from the group consisting of: an amino acid substitution at position 484; an amino acid substitution at position 198; an amino acid substitution at position 381; an amino acid substitution at position 387 and an amino acid substitution at position 484; an amino acid substitution at position 372, an amino acid substitution at position 480, and an amino acid substitution at position 484; an amino acid substitution at position 372, an amino acid substitution at position 387, and an amino acid substitution at position 480; an amino acid substitution at position 372, an amino acid substitution at position 387, and an amino acid substitution at position 484; an amino acid substitution at position 372, an amino acid substitution at position 387, an amino acid substitution at position 478, and an amino acid substitution at position 484; A484E; A484Y; N387L; T372Q; T372Y; T372Y and K478Y; K478Y; I370W; F198W; L381A; T368F; A484E, E375Y, K512Y, and T368F; A484Y, E375Y, K512Y, and T368F; N387L, E375Y, K512Y, and T368F; T372Q, E375Y, K512Y, and T368F; T372L, E375Y, K512Y, and T368F; T372Y, K478Y, E375Y, K512Y, and T368F; I370W, E375Y, K512Y, and T368F; F198W, E375Y, K512Y, and T368F; L381A, E375Y, K512Y, and T368F; and E375Y, K512Y, and T368F. A K512F substitution (or K512W, K512L, K512I, K512V, K512H, etc.) is optionally employed, e.g., where a K512Y substitution is listed herein. As another example, the modified polymerase can include an insertion of at least one amino acid (e.g., 1-7 amino acids, e.g., glycine) within residues 372-397 and/or 507-514. For example, a glycine residue can be introduced after residue 374, 375, 511, and/or 512 (designated as 374.1G, 375.1G, etc.).

Figure 34:
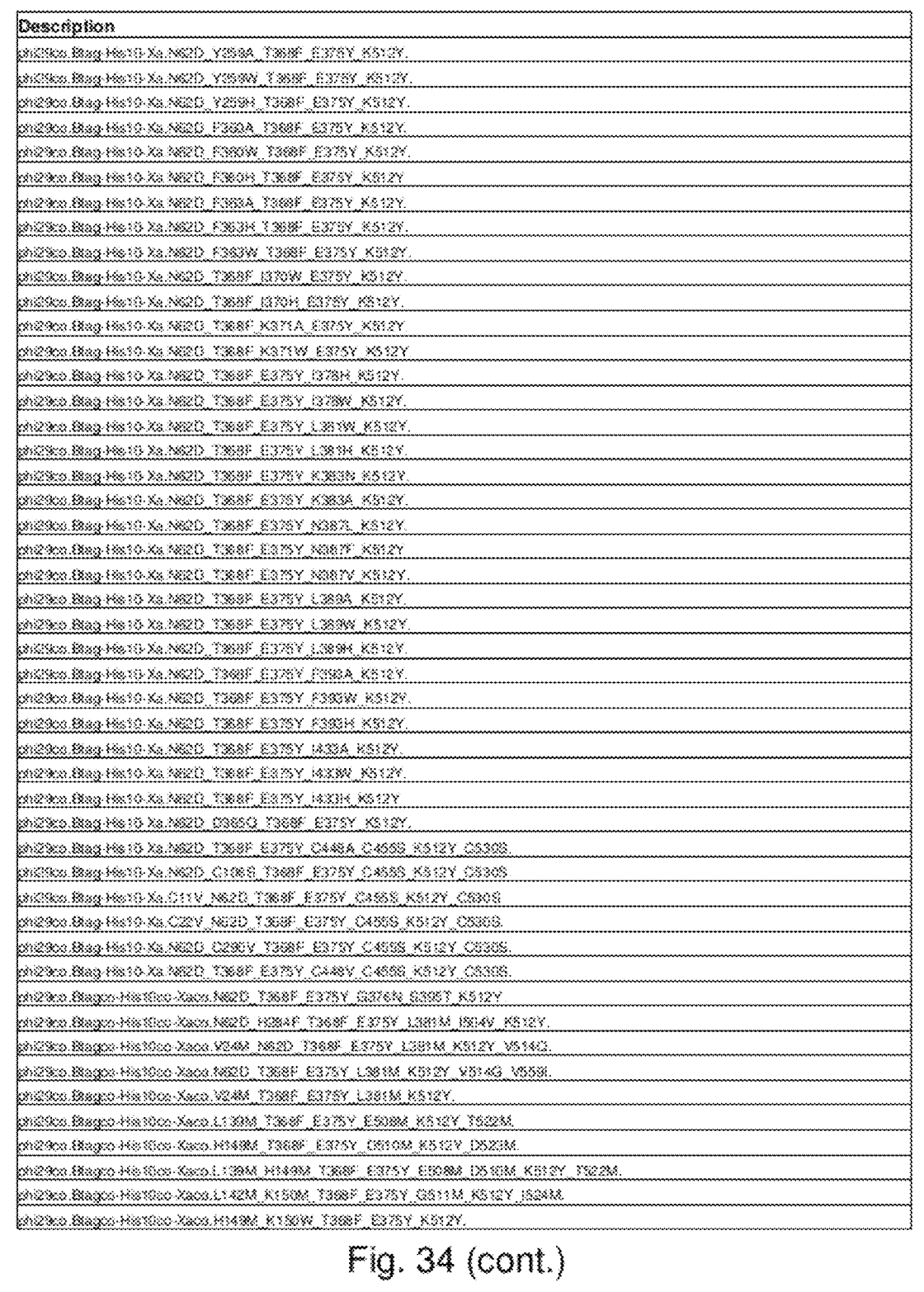
Figure 34:
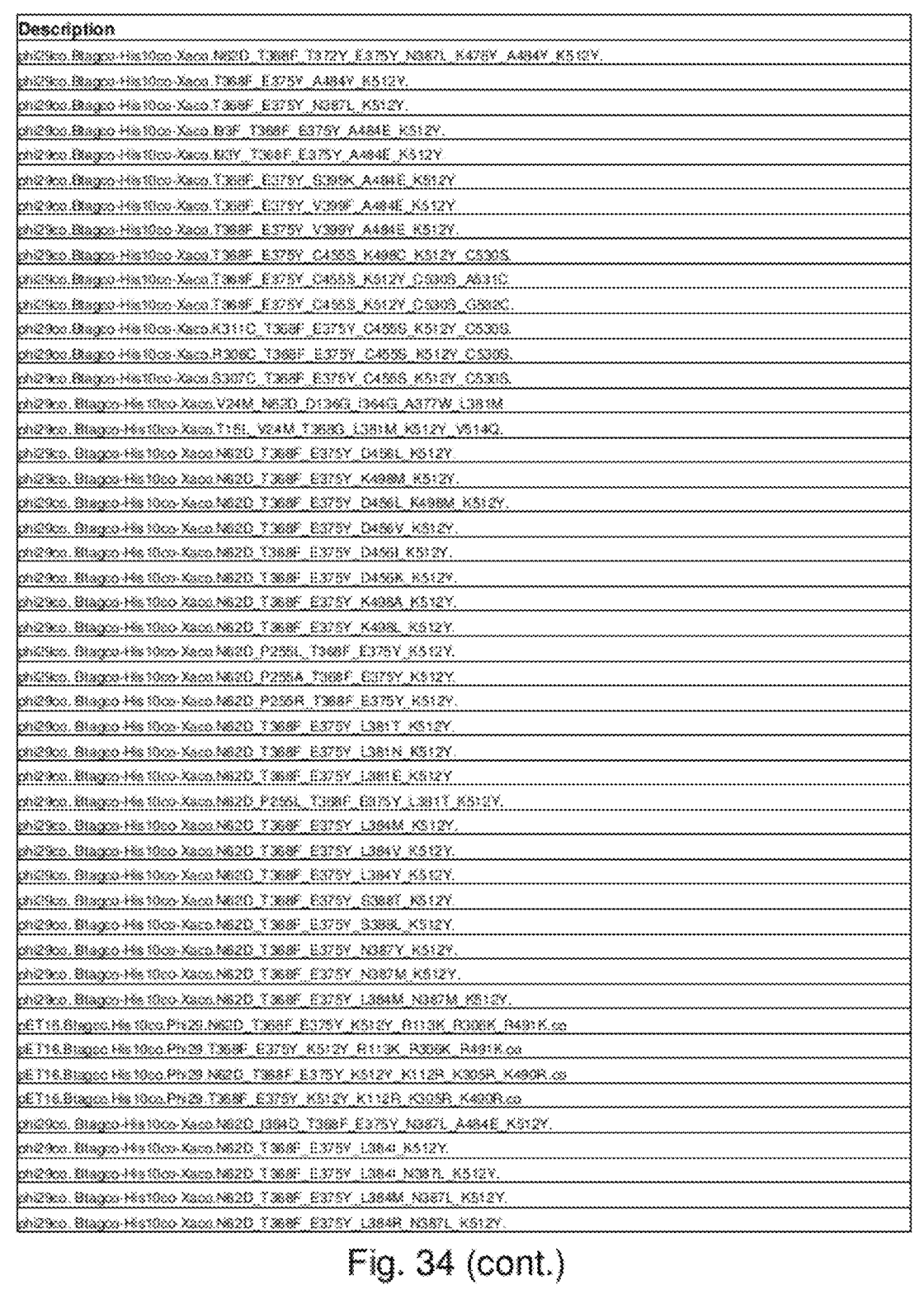
Figure 34:
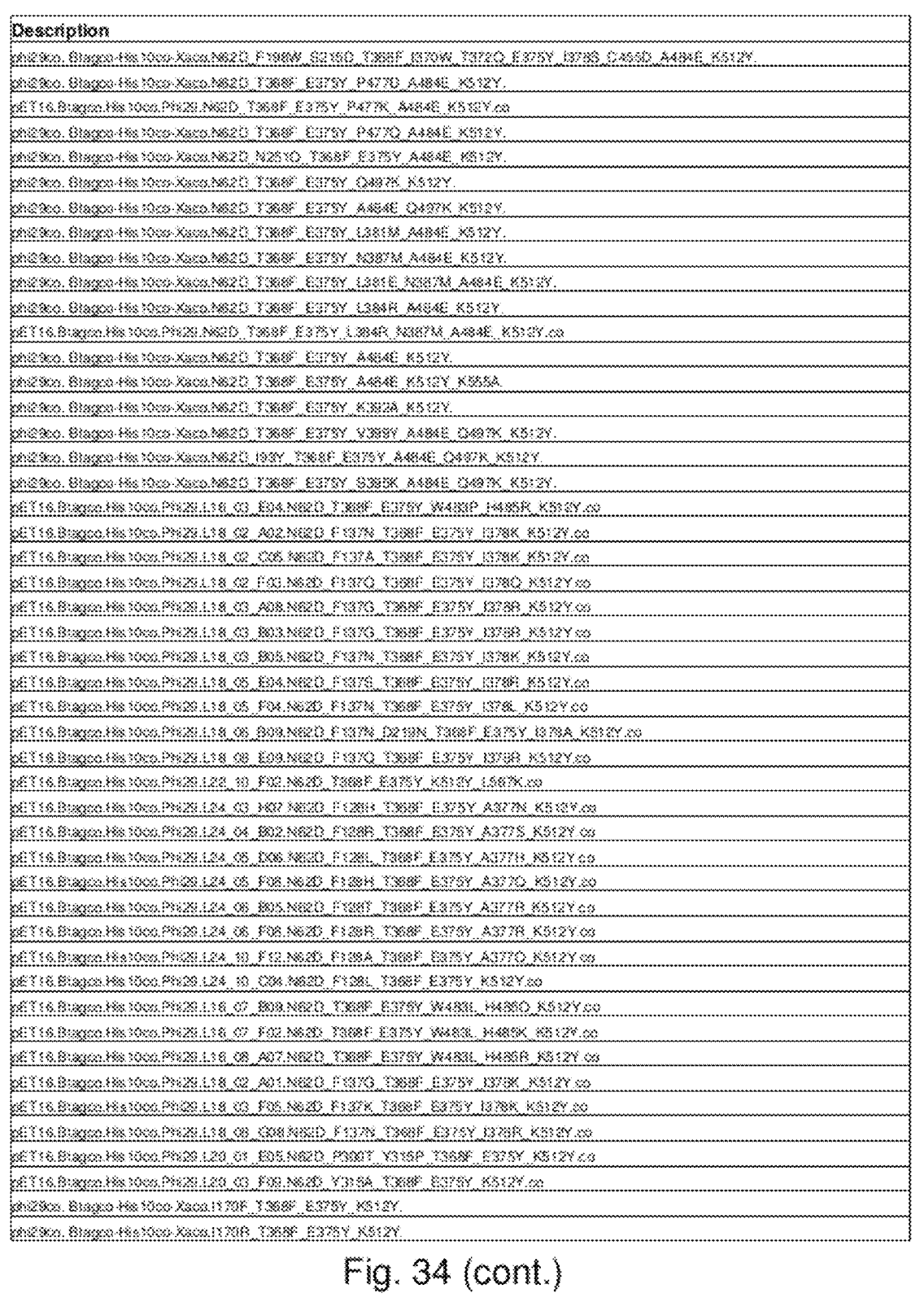
Figure 35:
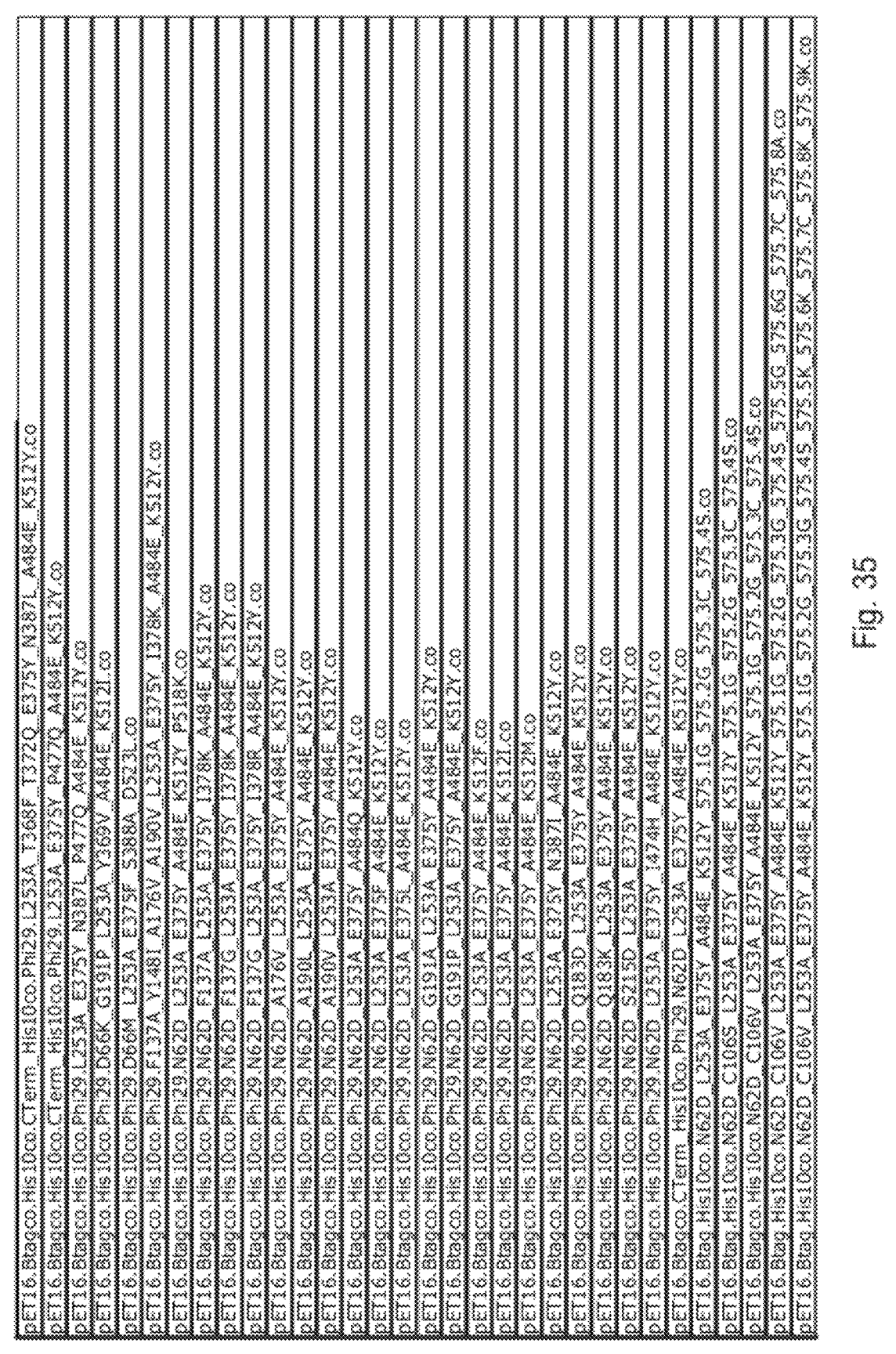
Figure 35:
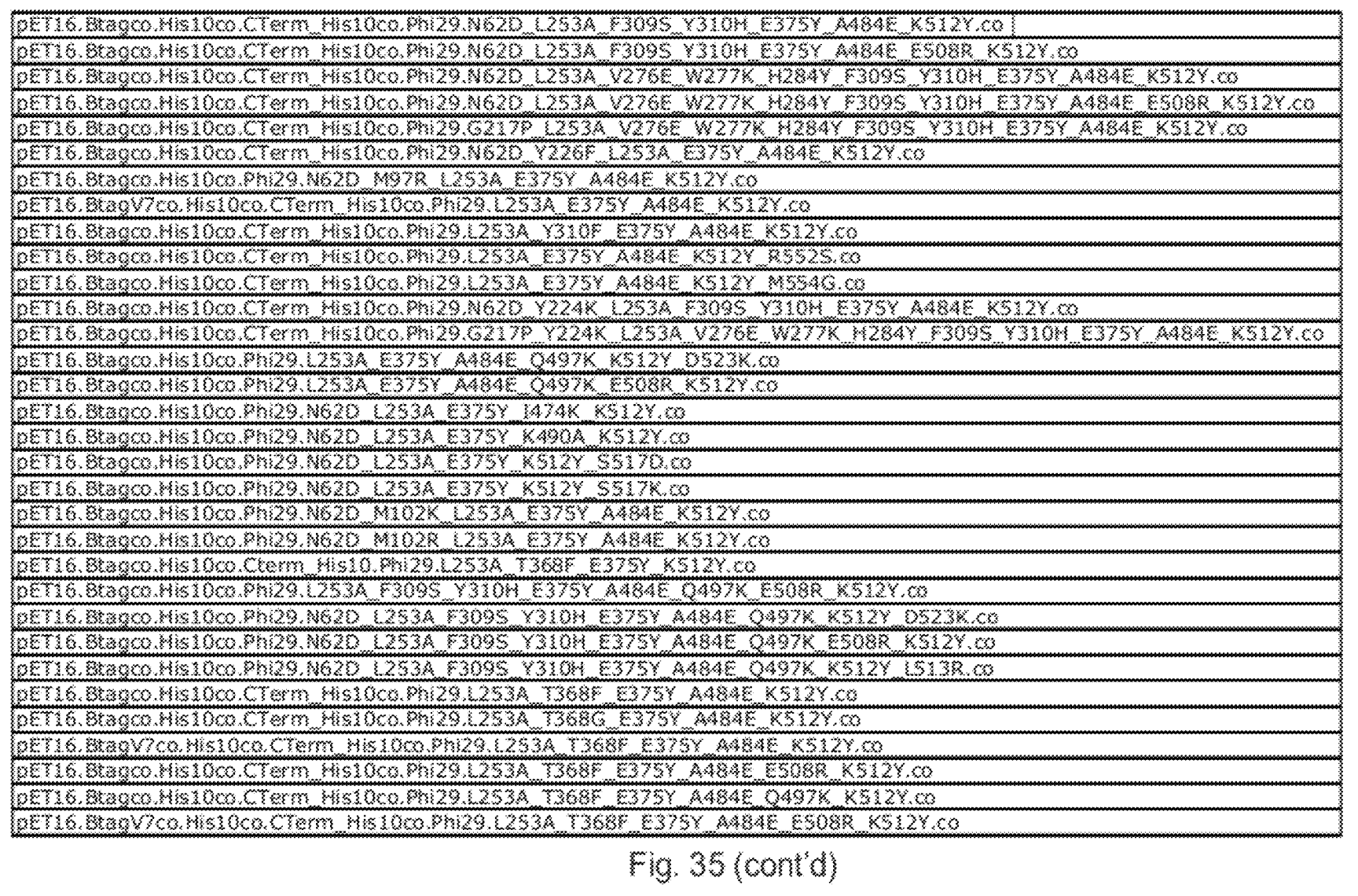
Figure 35:
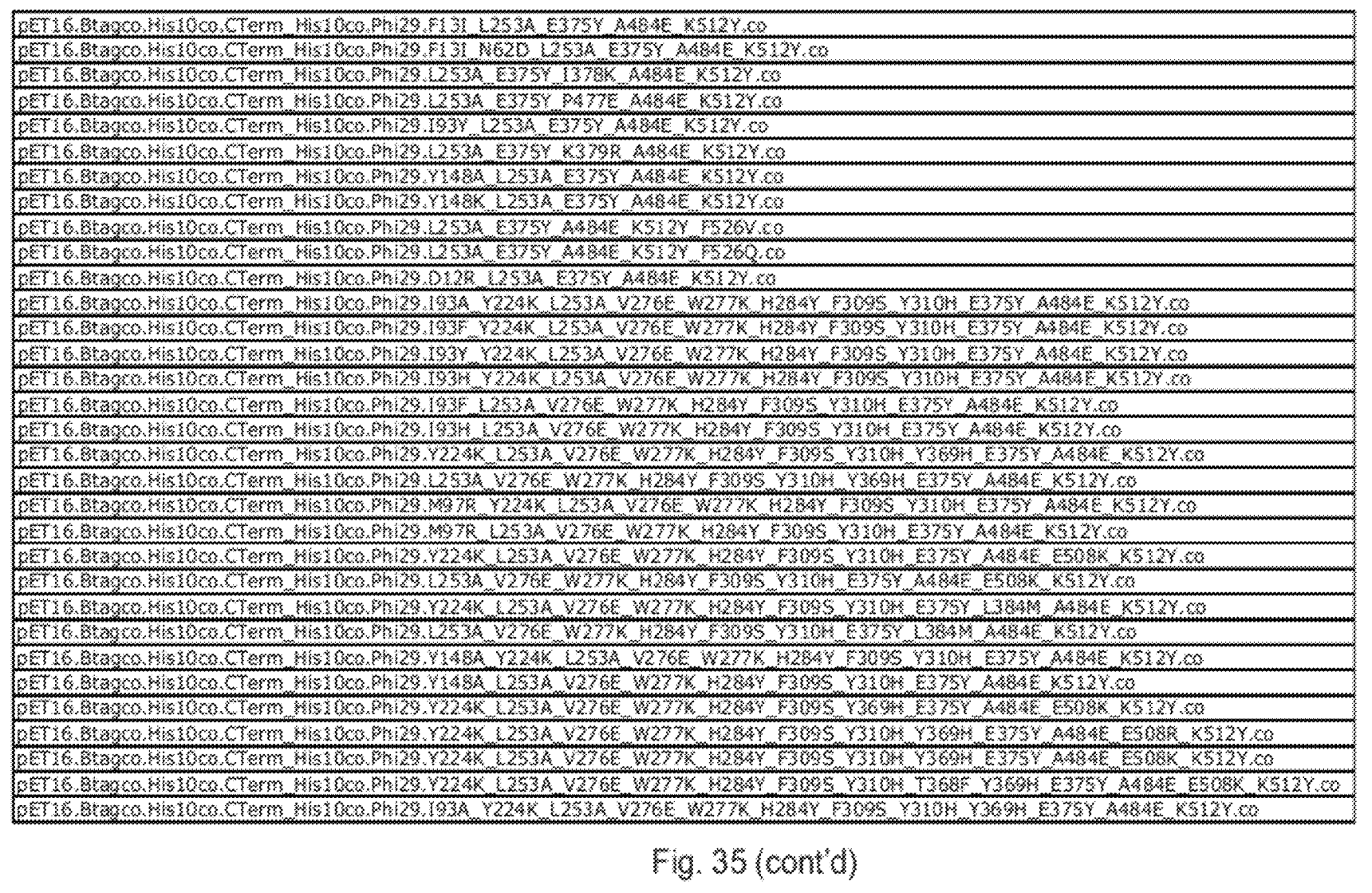
Figure 35:
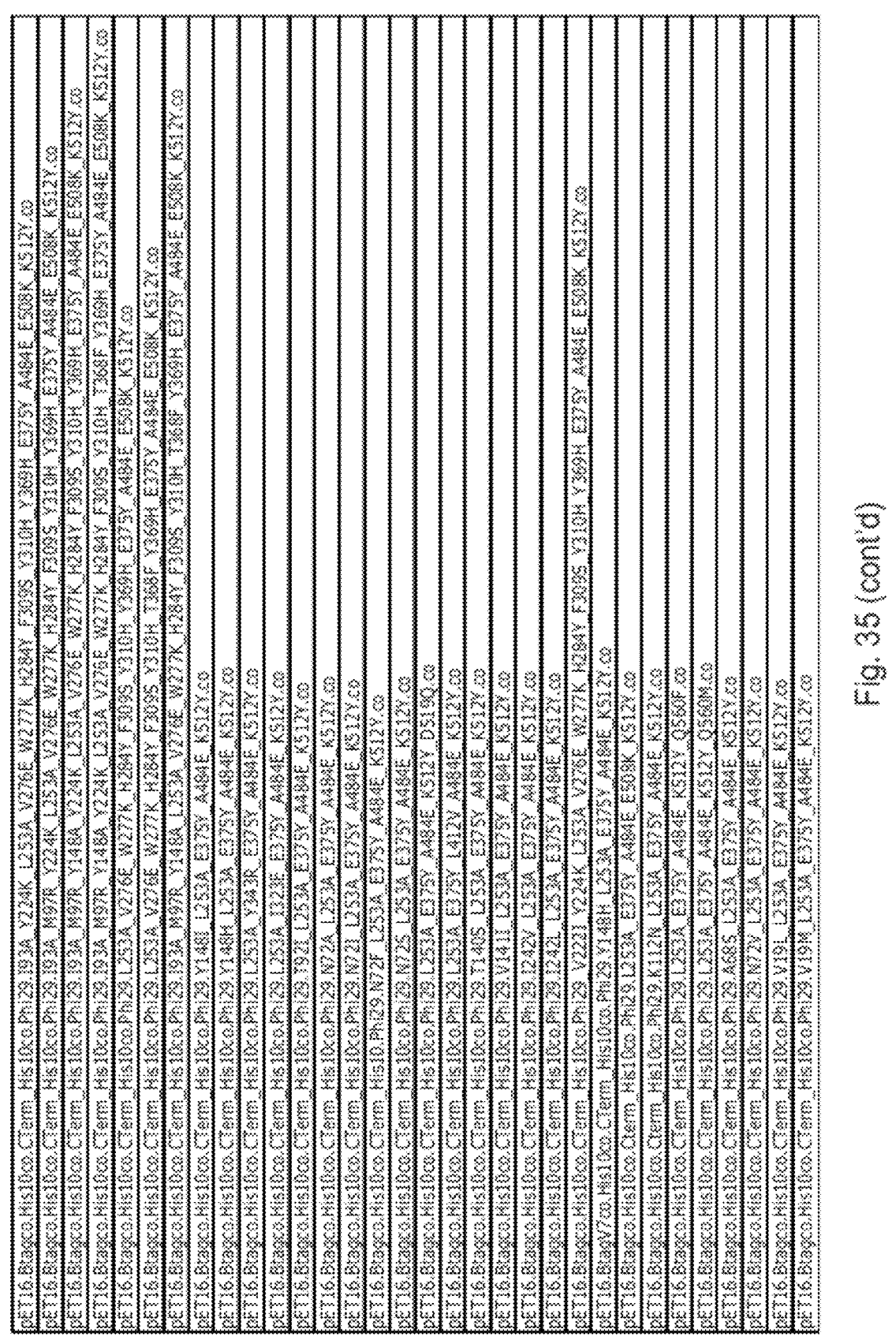
Figure 35:
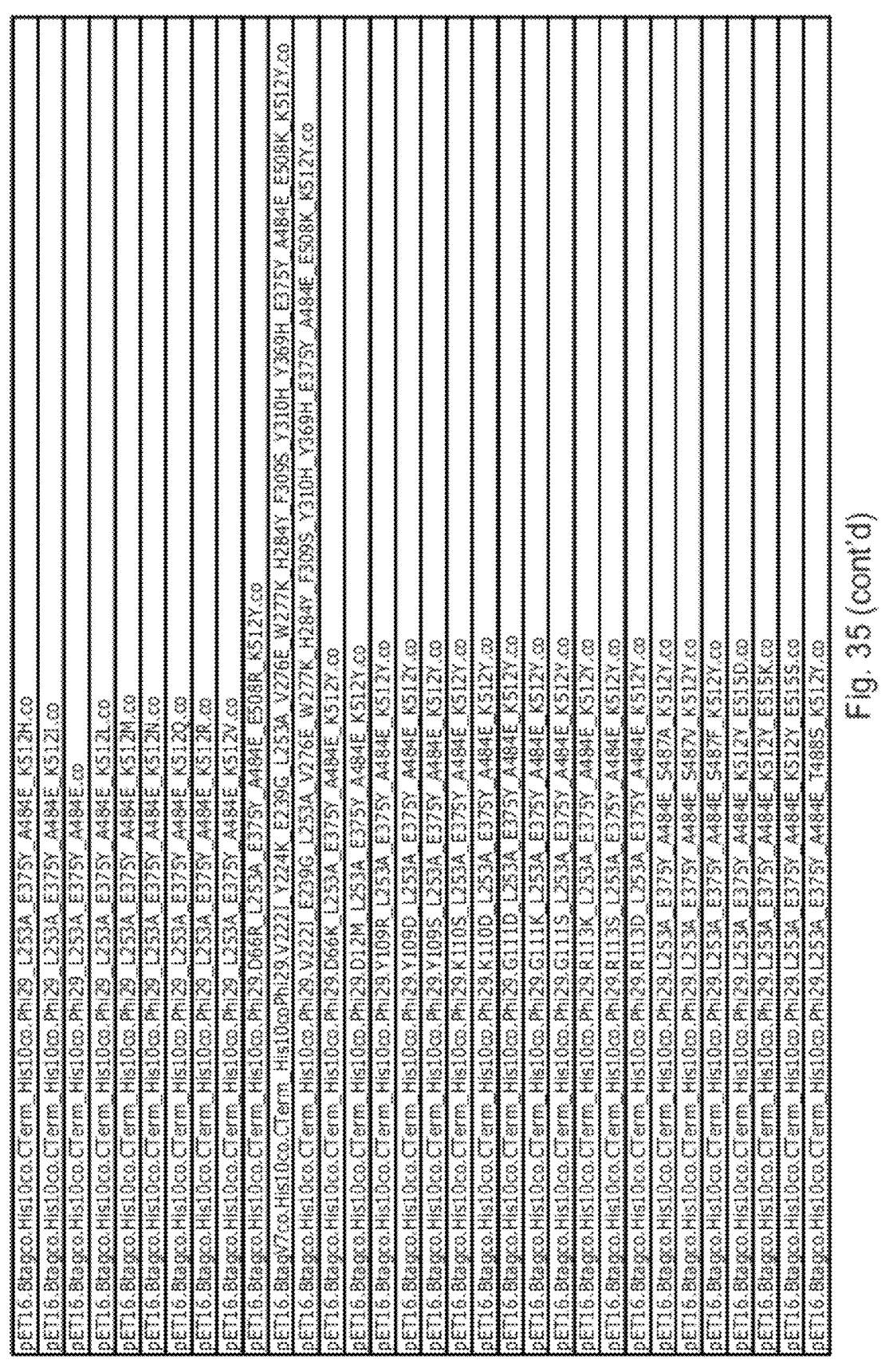
Figure 35:
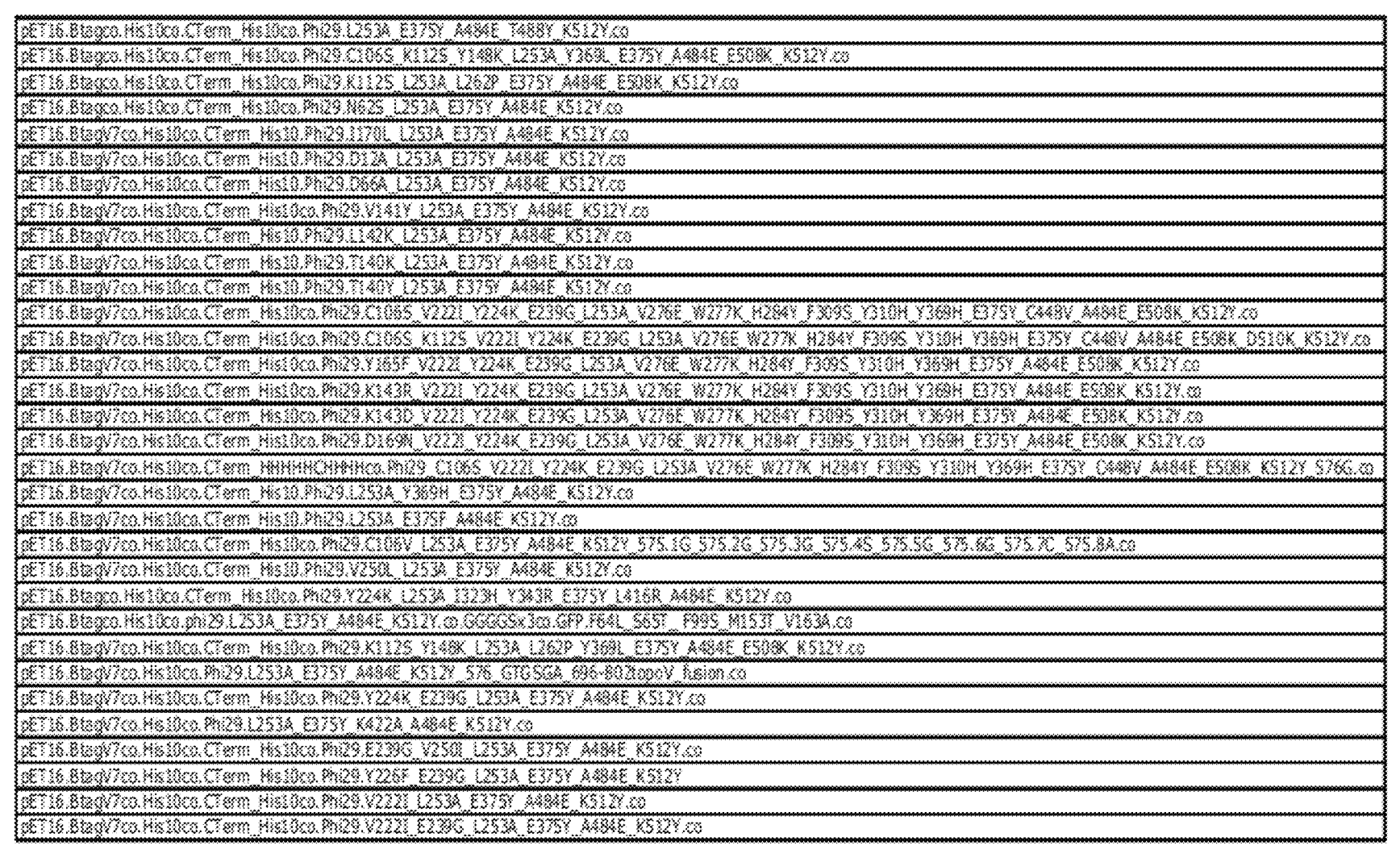
Figure 35:
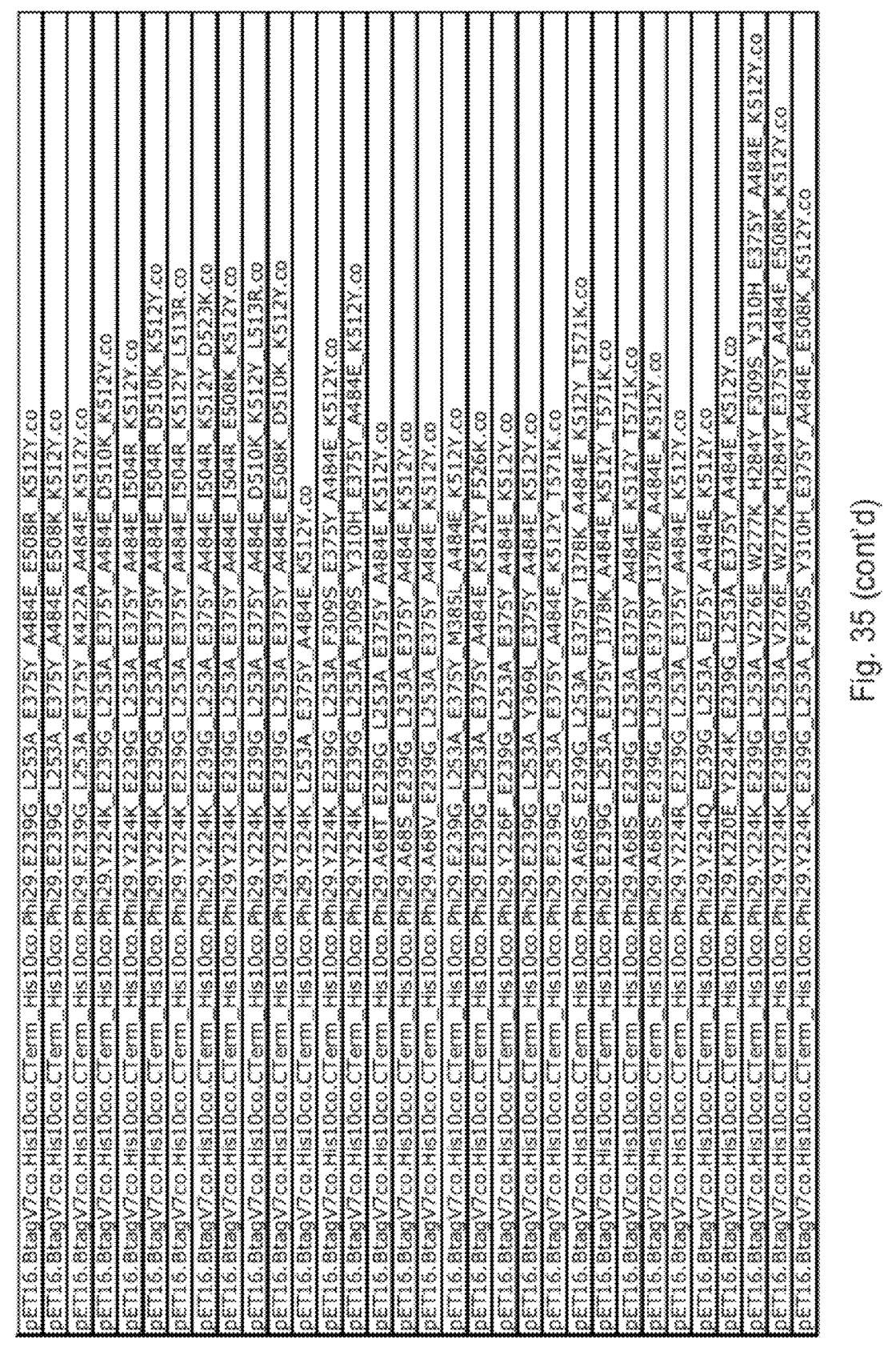
Figure 35:
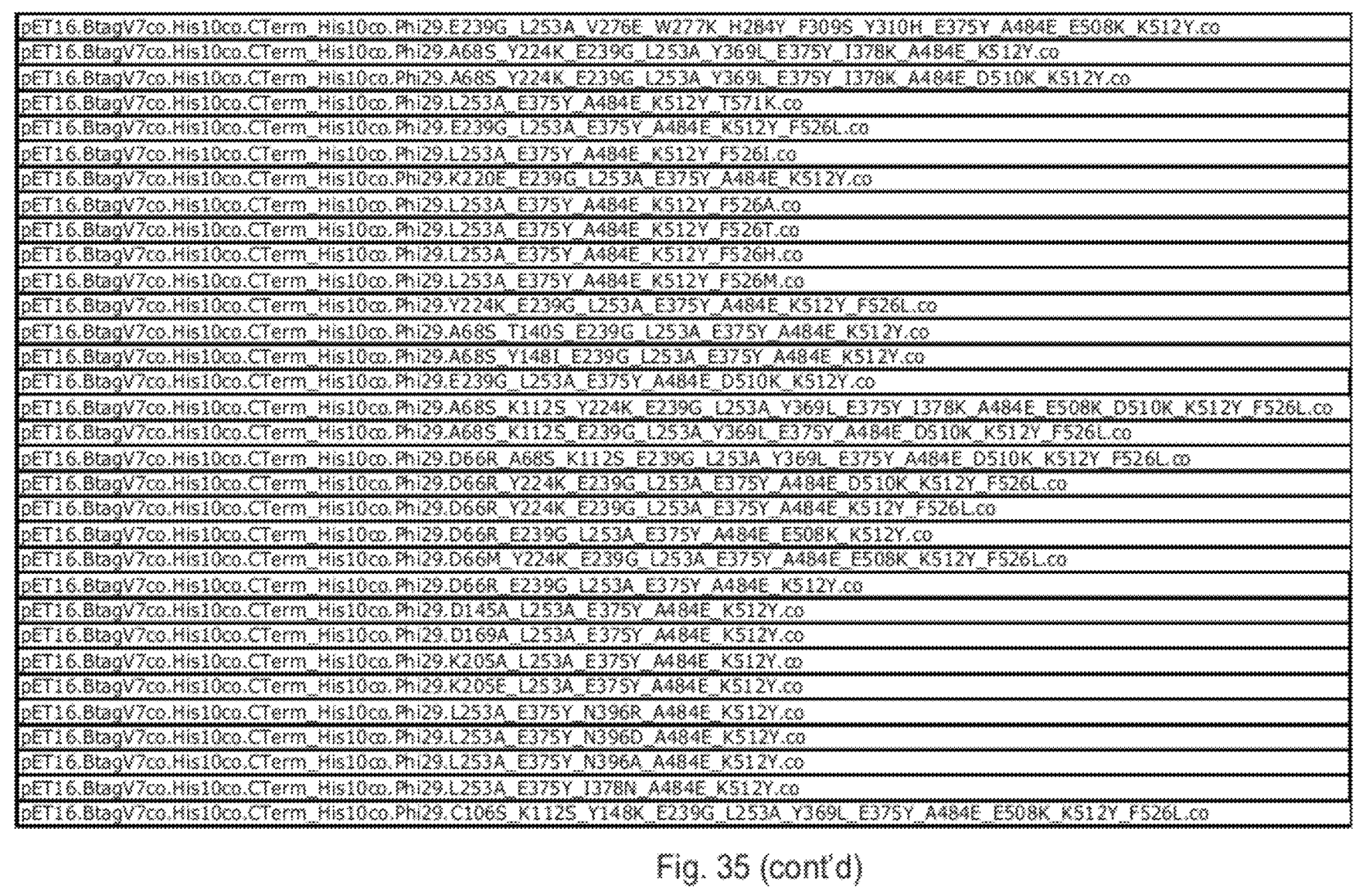
Figure 35:
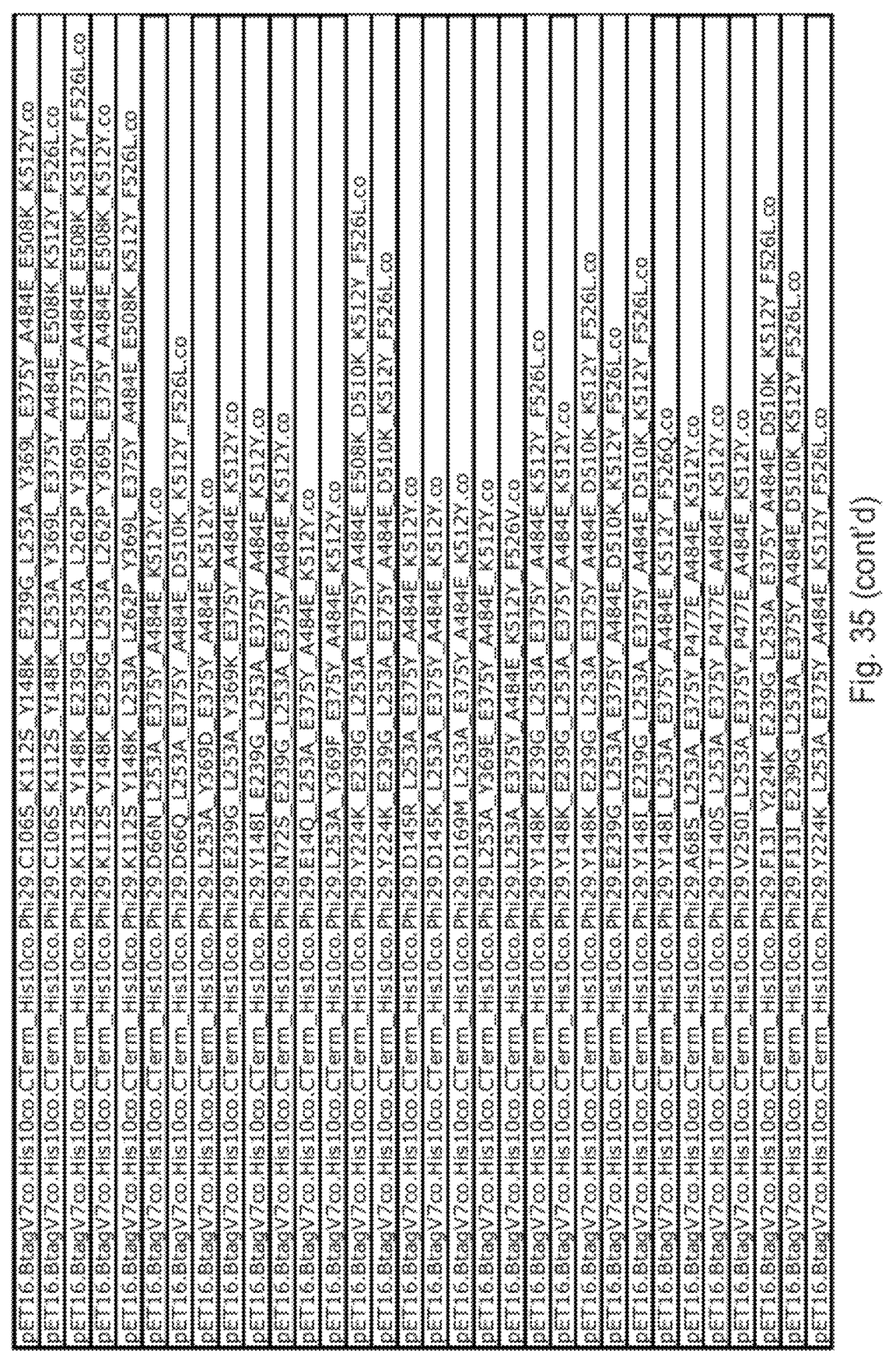
Figure 35:
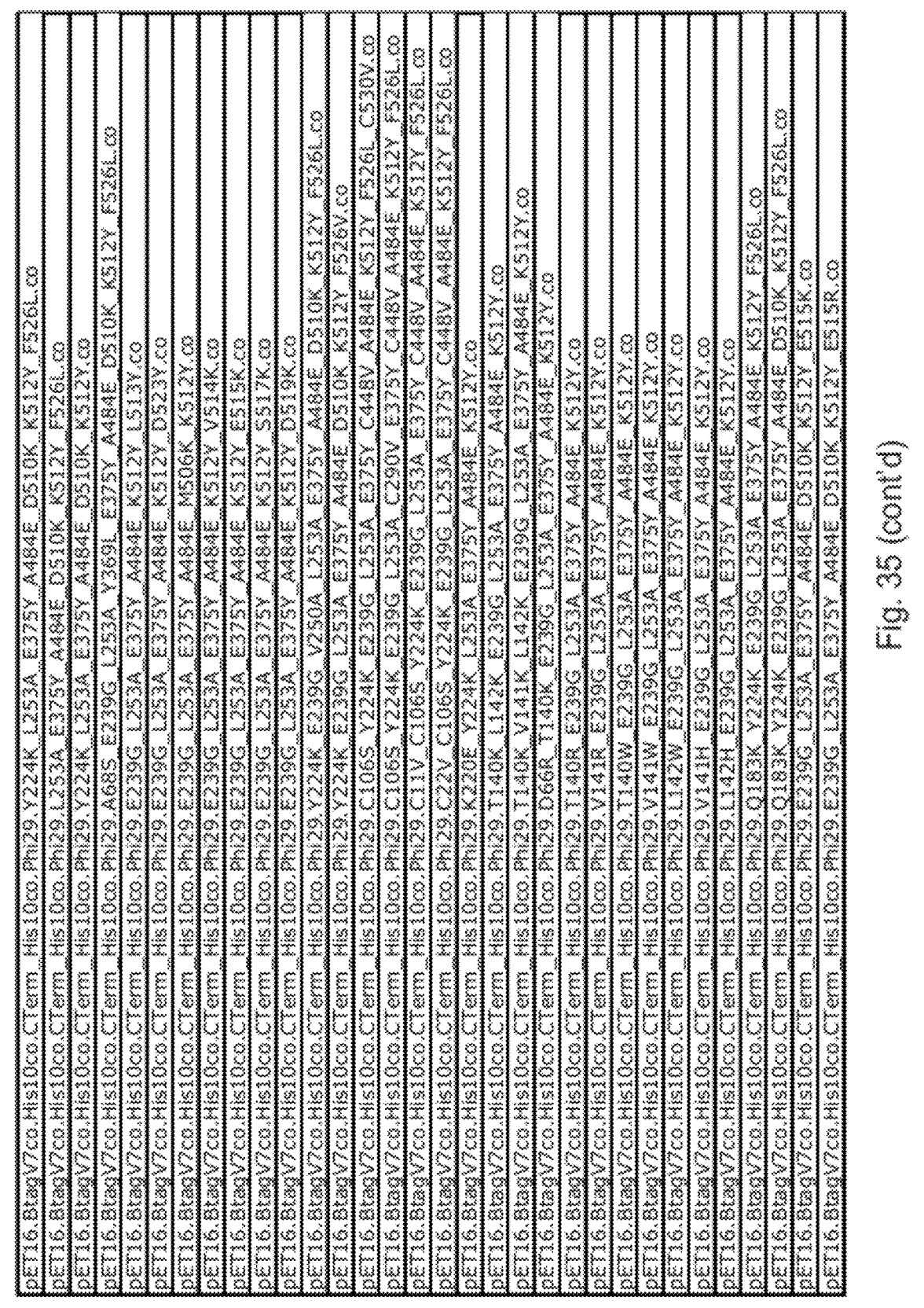
Figure 35:
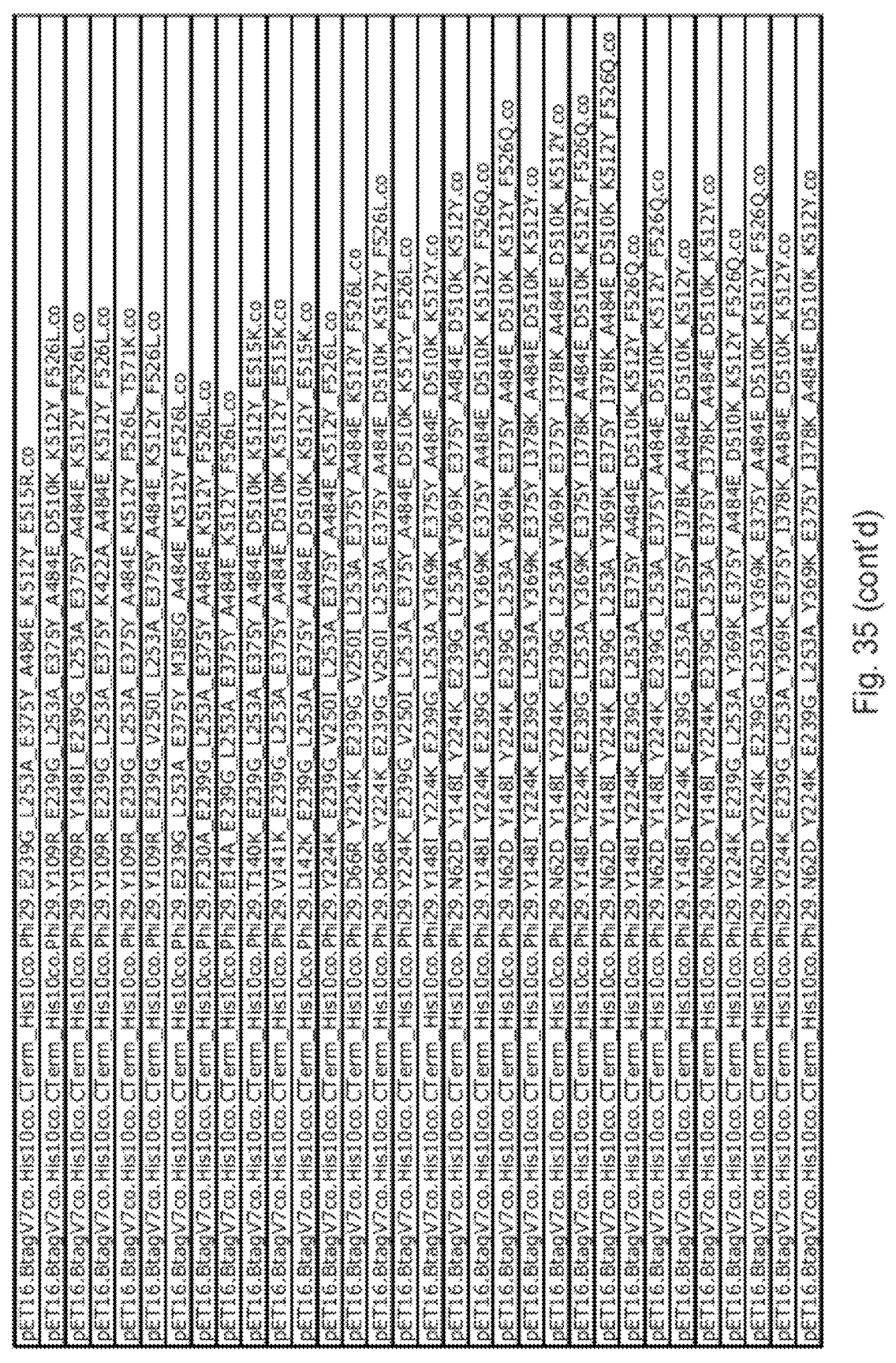
Figure 35:
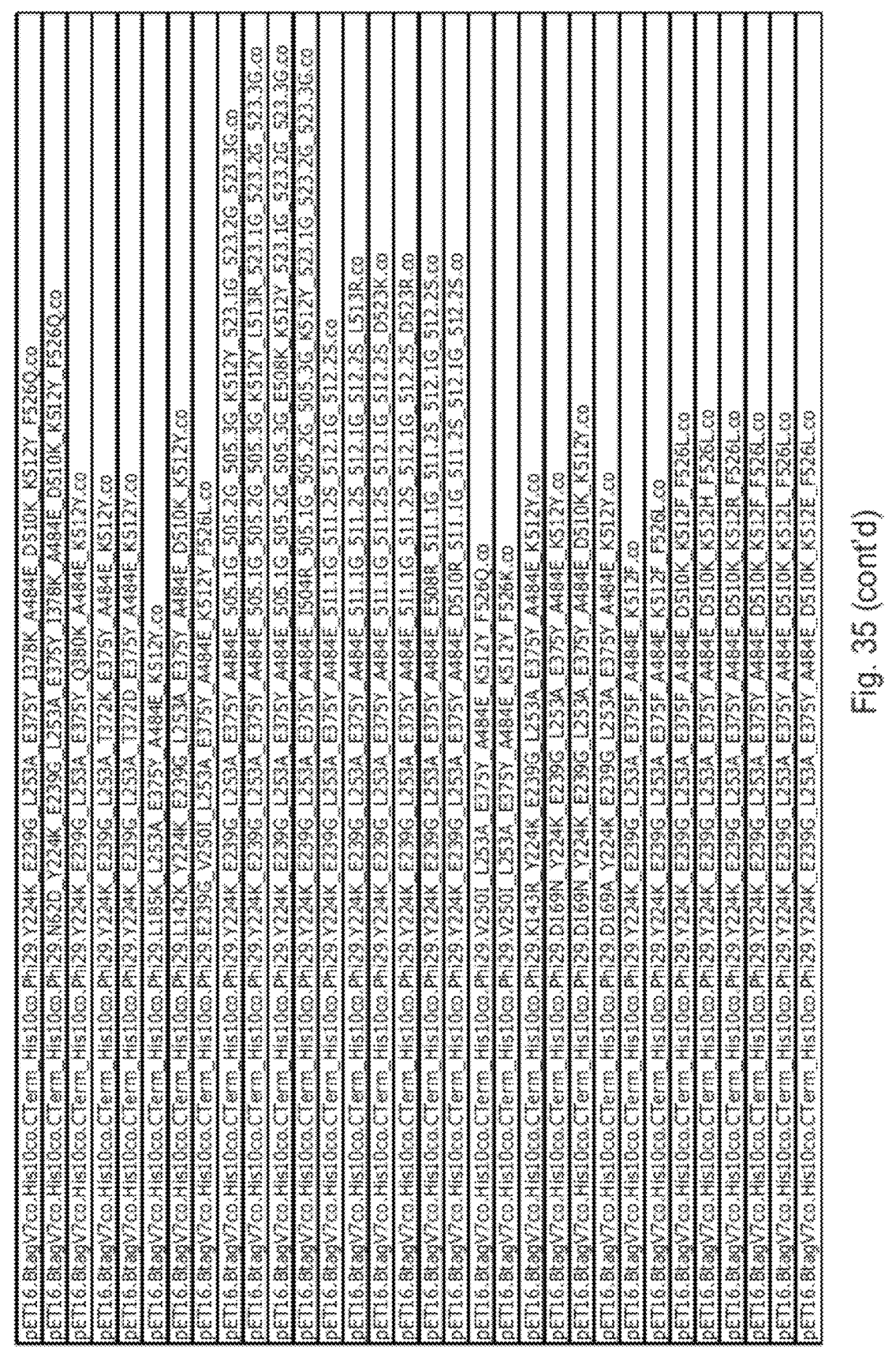
Figure 35:
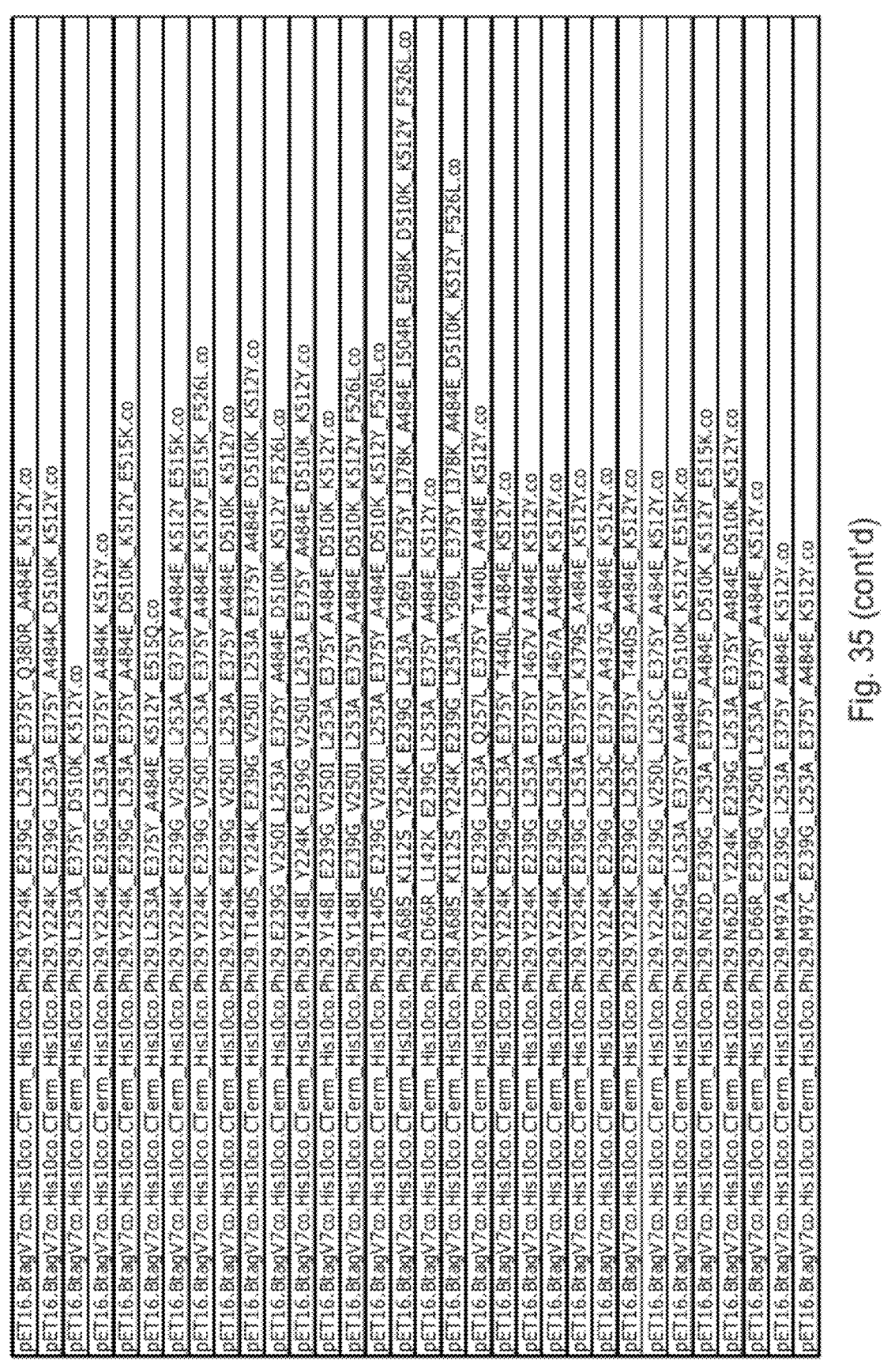
Figure 35:
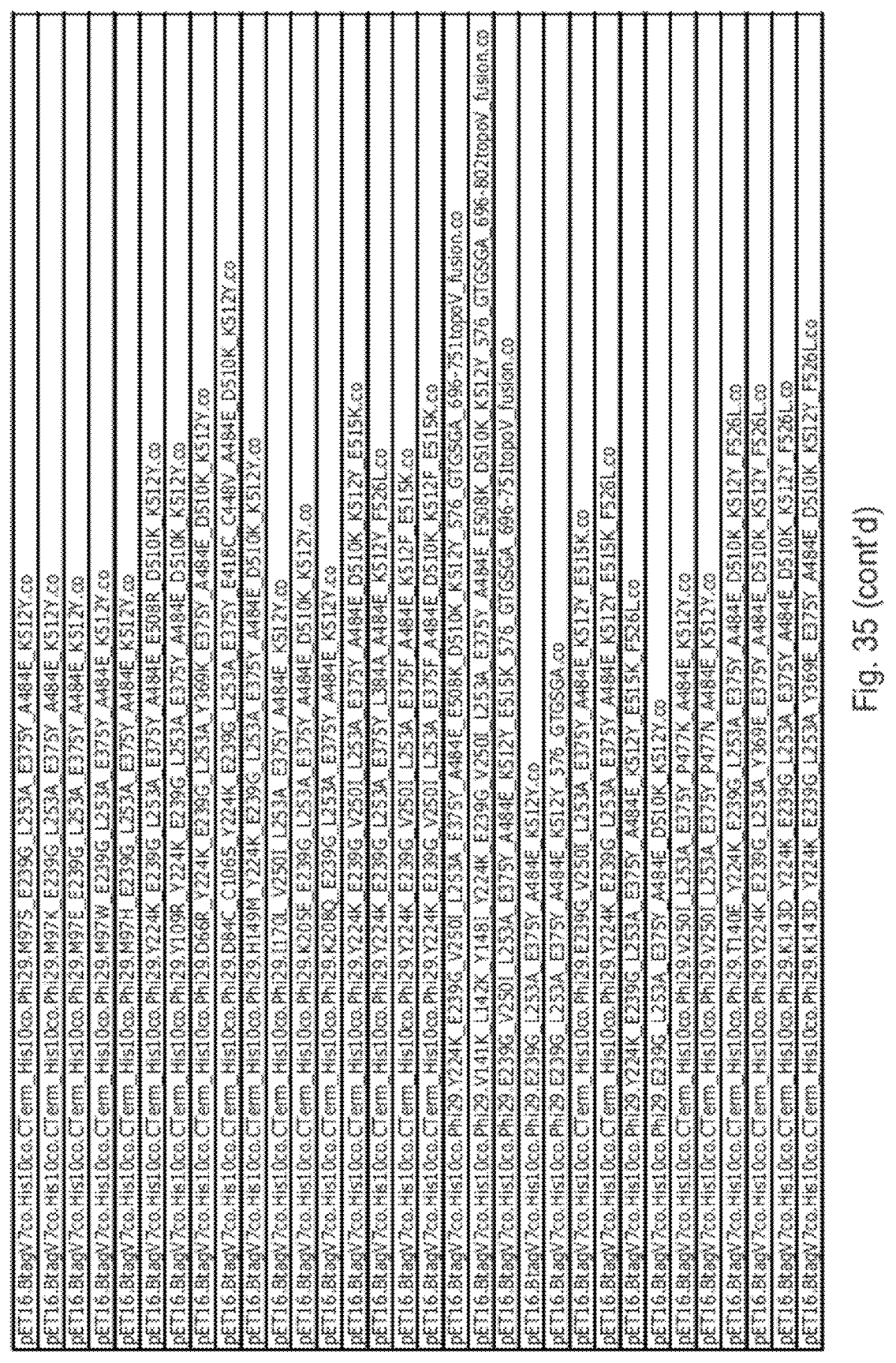
Figure 35:
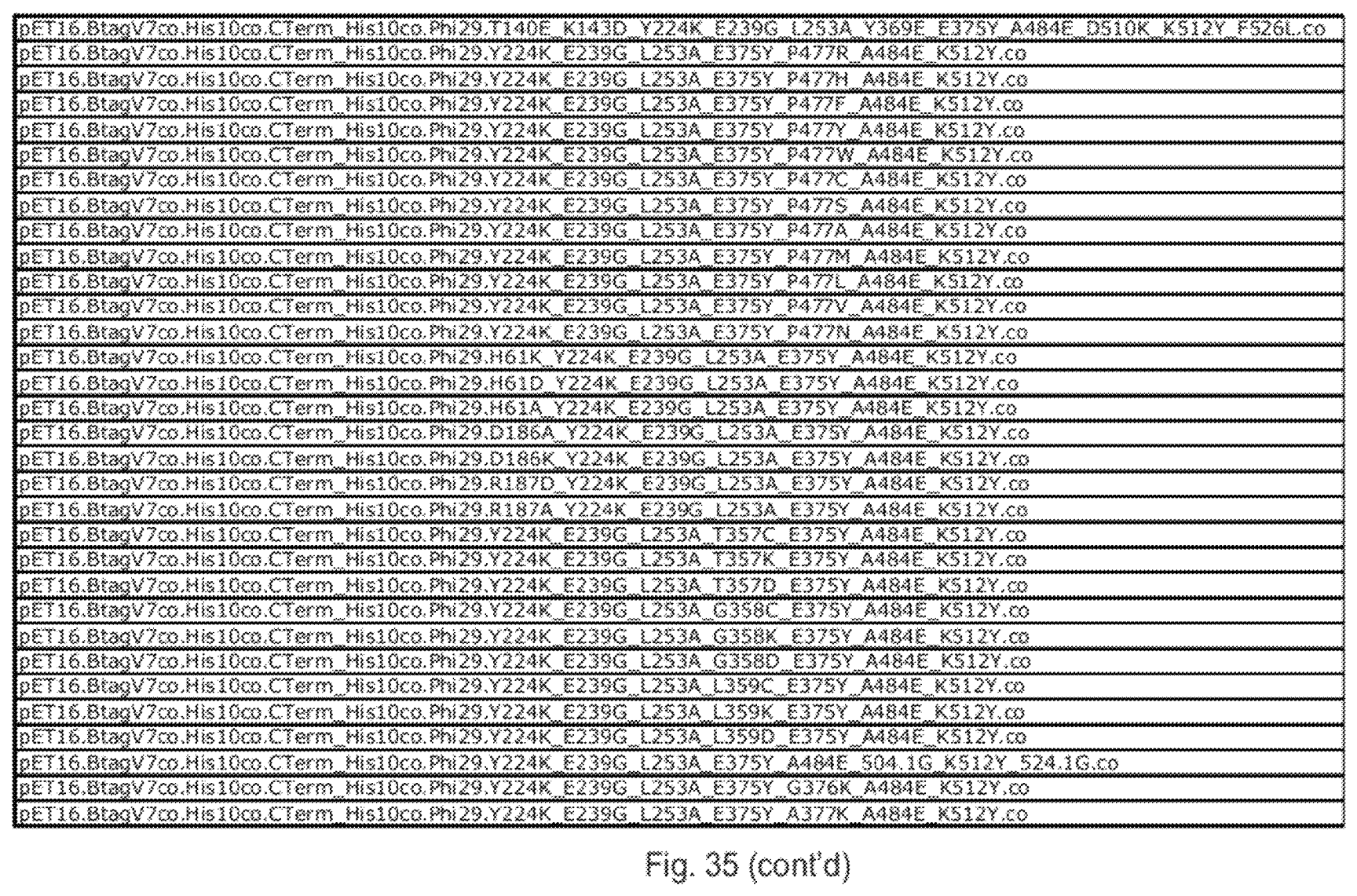
Figure 35:
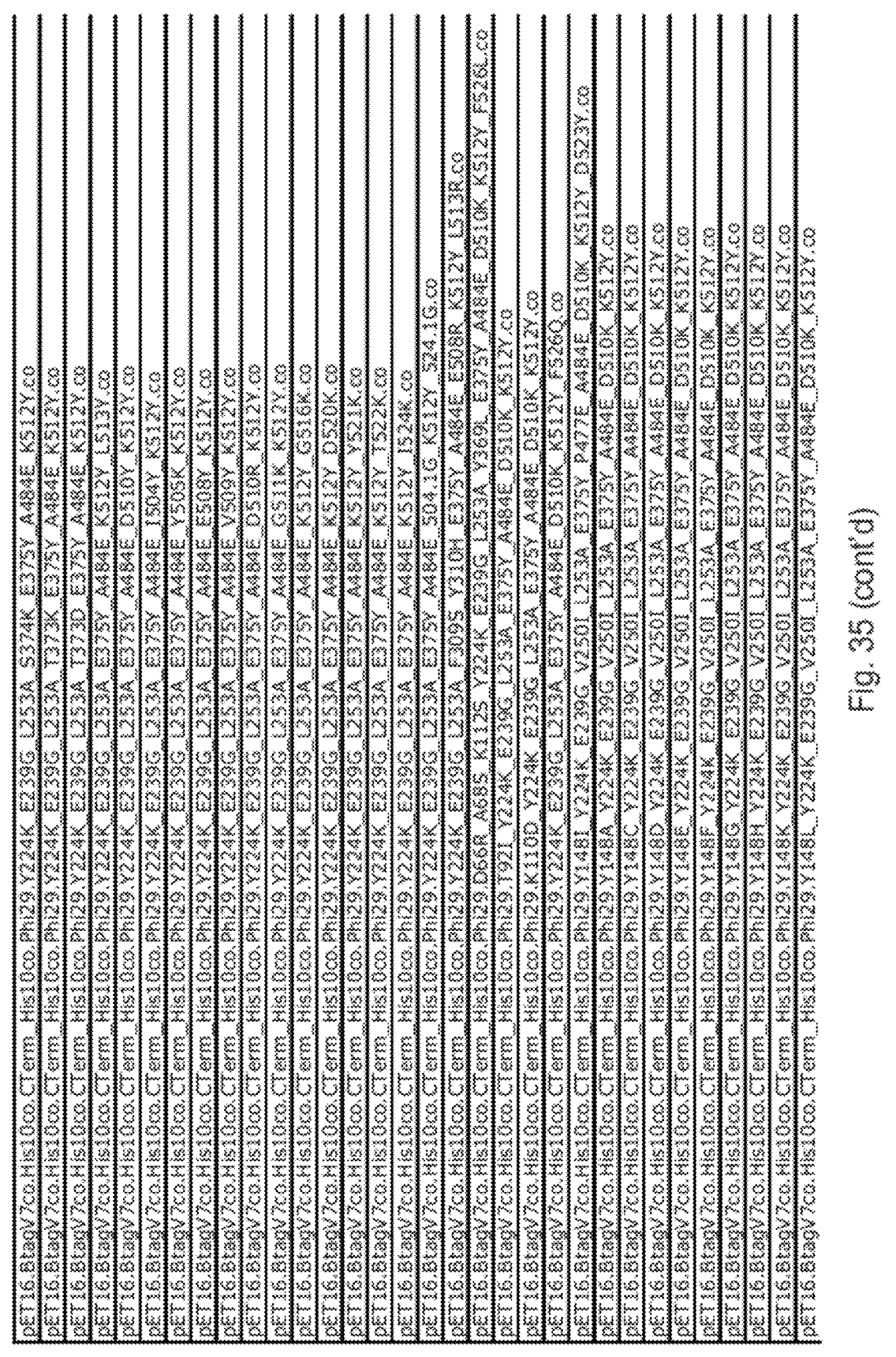
Figure 35:
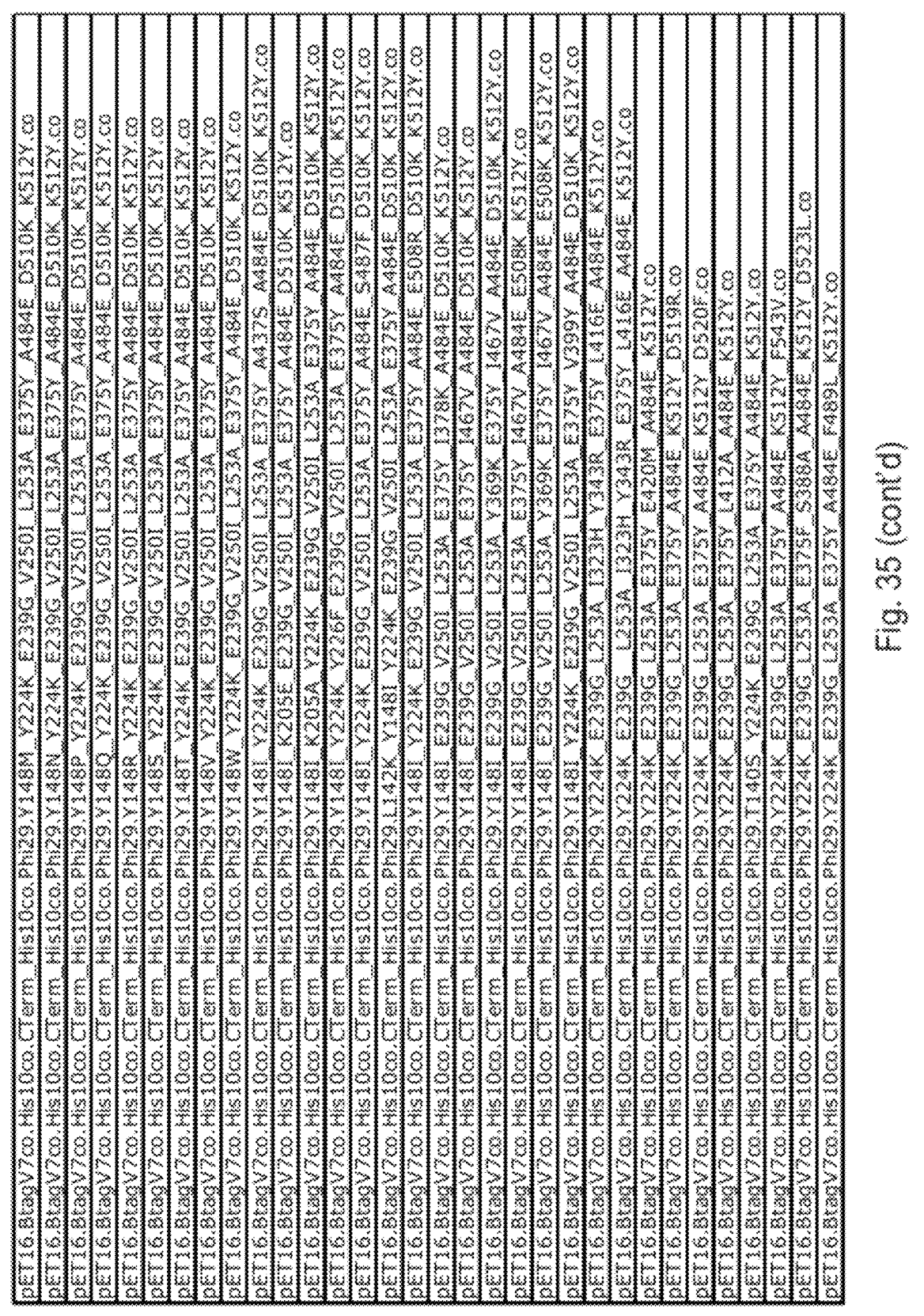
Figure 35:
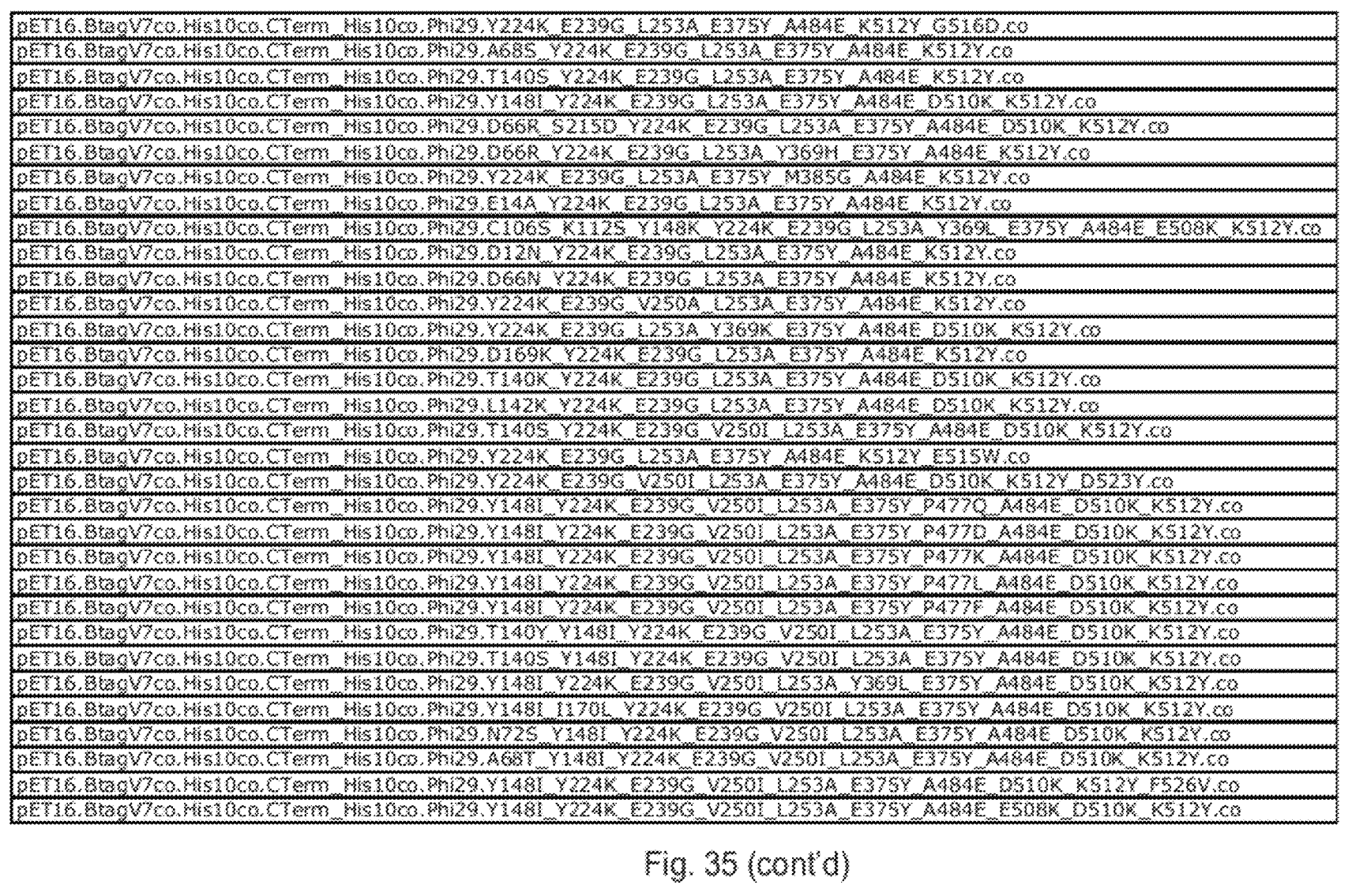
Figure 35:
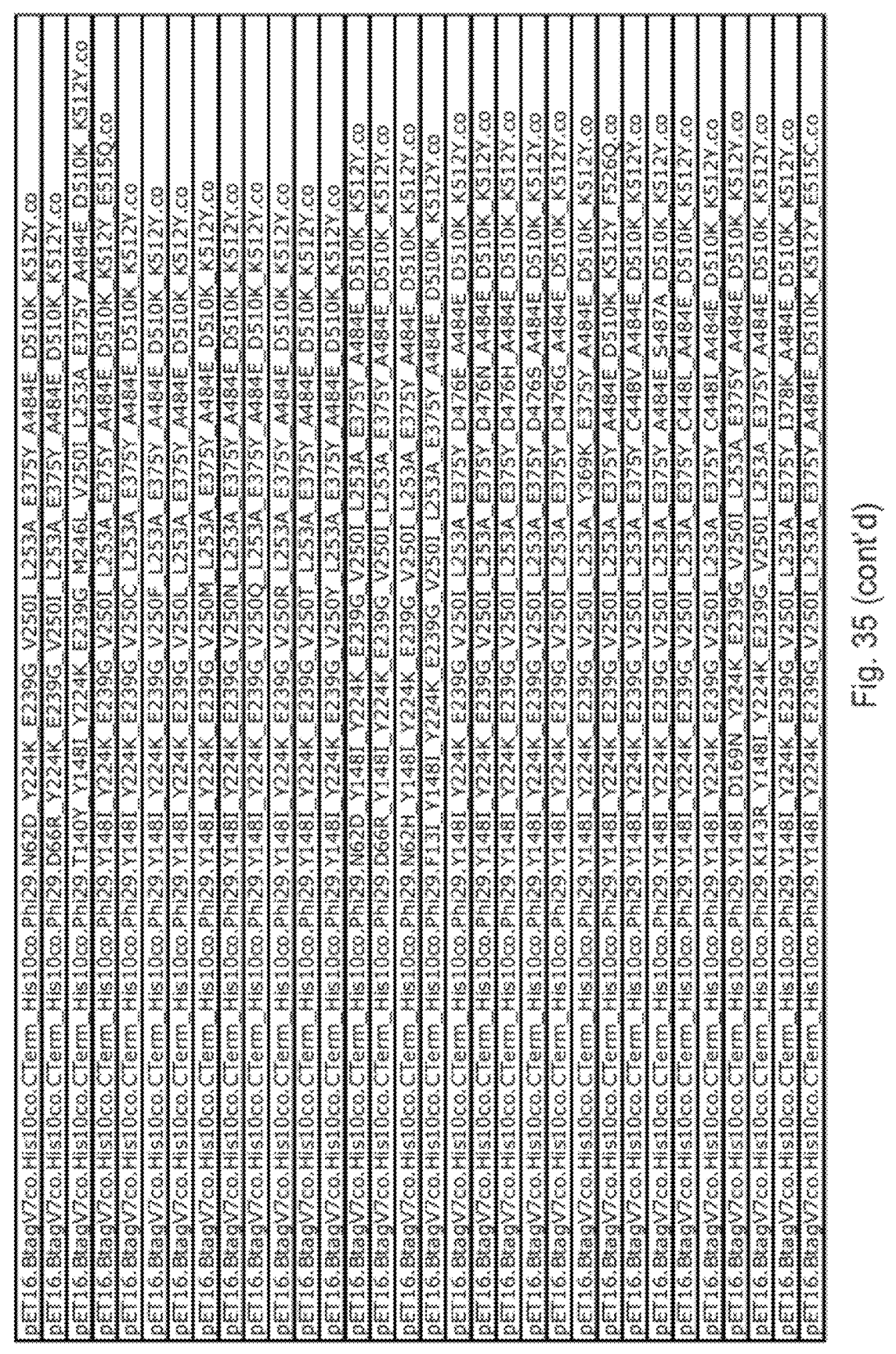
Figure 35:
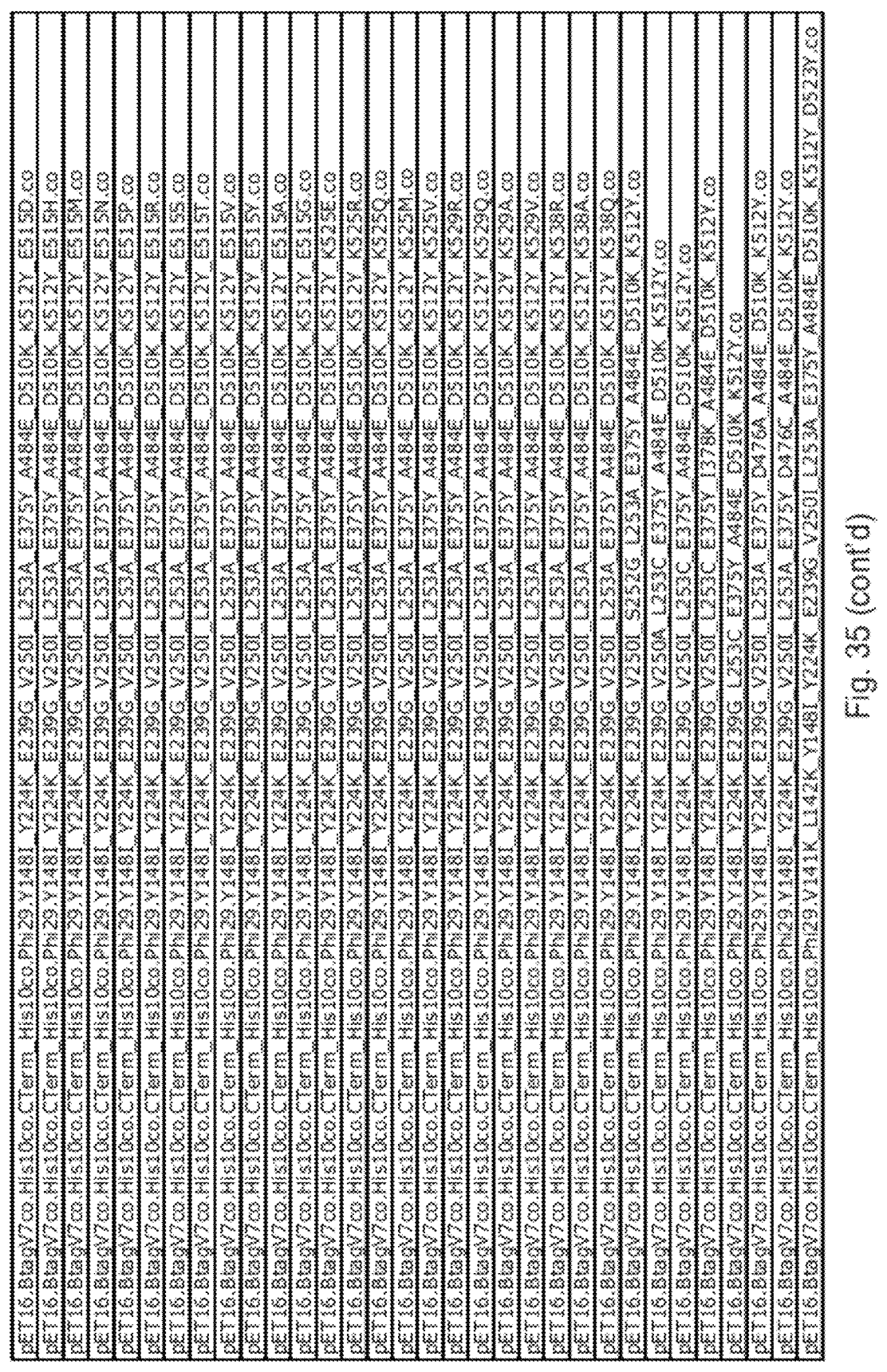
Figure 35:
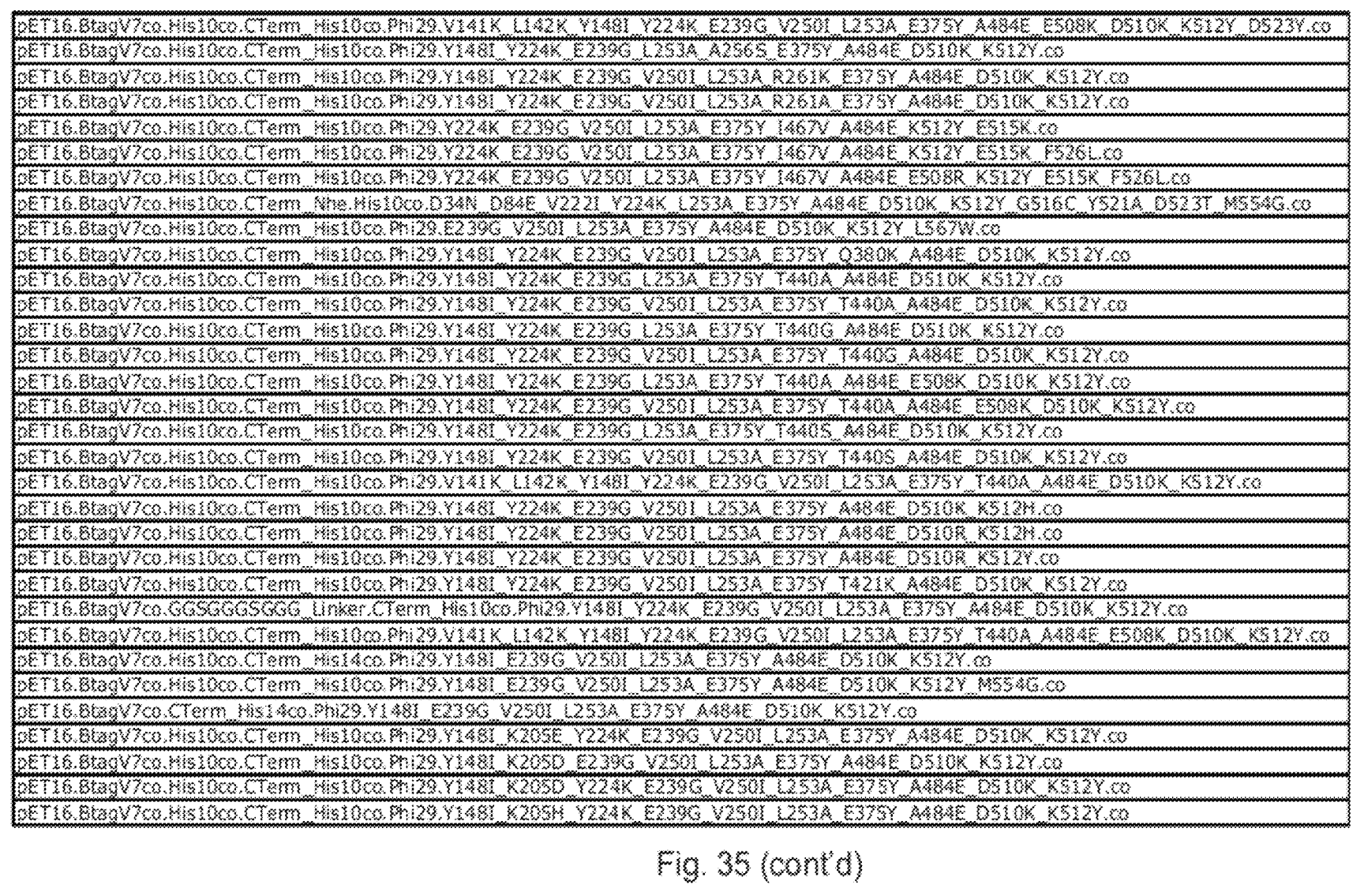
Figure 35:
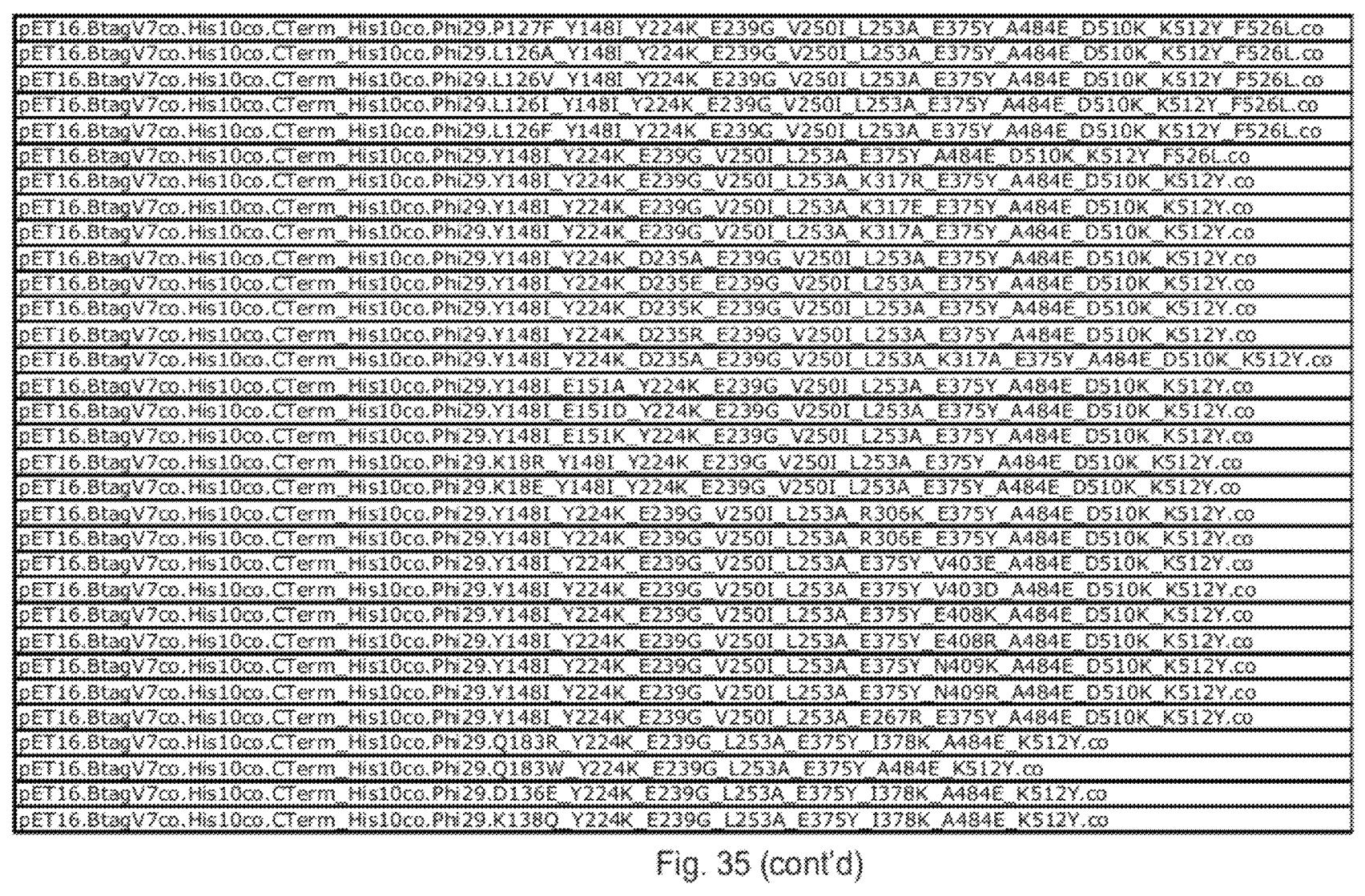
Figure 35:
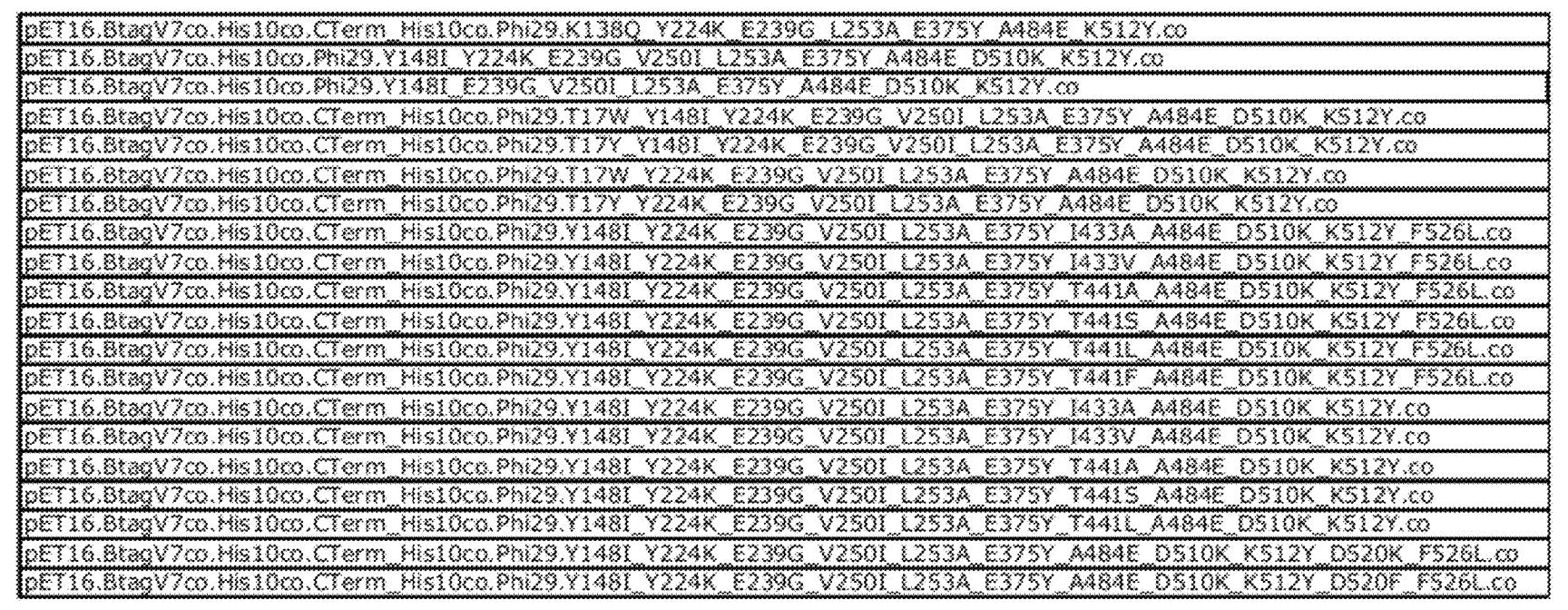

A list of exemplary mutations and combinations thereof is provided in Table 1, and additional exemplary mutations are described herein, e.g., in Tables 2-5, 13, and 16 and FIGS. 34-35. Essentially any of these mutations, or any combination thereof, can be introduced into a polymerase to produce a modified recombinant polymerase (e.g., into wild-type Φ29, a wild-type or exonuclease deficient Φ29-type polymerase, and/or an E375Y/K512Y/T368F, E375Y/K512Y/T368F/A484E, E375Y/K512Y/A484E, E375Y/K512Y/T368G/ A484E, E375Y/K512Y/L253A, or E375Y/K512Y/L253A/A484E Φ29 or Φ29-type polymerase, as just a few examples).

TABLE 1

| Mutation | Rationale |
| --- | --- |
| D249E | metal coordination |
| A484E | metal coordination |
| D249E/A484E | metal coordination |
| A484D | metal coordination |
| A484H | metal coordination |
| A484Y | metal coordination |
| D249E/A484D | metal coordination |
| D249E/A484H | metal coordination |
| D249E/A484Y | metal coordination |
| 374.1G/375.1A | dye interaction |
| 374.1Gins/375.1Gins | dye interaction |
| V514Y | dye interaction |
| V514F | dye interaction |
| 511.1G/K512Y/512.1G | dye interaction |
| T372H | closed conformation of fingers |
| T372V | closed conformation of fingers |
| T372I | closed conformation of fingers |
| T372F | closed conformation of fingers |
| T372Y | closed conformation of fingers |
| T372N | closed conformation of fingers |
| T372Q | closed conformation of fingers |
| T372L | closed conformation of fingers |
| T372L/K478Y | closed conformation of fingers |
| T372Y/K478Y | closed conformation of fingers |
| T372Y/K478L | closed conformation of fingers |
| K478Y | closed conformation of fingers |
| D365N | closed conformation of fingers |
| D365Q | closed conformation of fingers |
| L480H | closed conformation of fingers |
| L480F | closed conformation of fingers |
| L381A | closed conformation of finger and exo |
| I179A | closed conformation of finger and exo |
| I378A | closed conformation of finger and exo |
| I179A/L381A | closed conformation of finger and exo |
| I179A/I378A/L381A | closed conformation of finger and exo |
| I370A/I378A | closed conformation of finger and exo |
| I179A/I370A/I378A/L381A | closed conformation of finger and exo |
| I179W | closed conformation of finger and exo |
| I179H | closed conformation of finger and exo |
| F211A | closed conformation of finger and exo |
| F211W | closed conformation of finger and exo |
| F211H | closed conformation of finger and exo |
| F198A | closed conformation of finger and exo |
| F198W | closed conformation of finger and exo |
| F198H | closed conformation of finger and exo |
| P255A | closed conformation of finger and exo |
| P255W | closed conformation of finger and exo |
| P255H | closed conformation of finger and exo |
| Y259A | closed conformation of finger and exo |
| Y259W | closed conformation of finger and exo |
| Y259H | closed conformation of finger and exo |
| F360A | closed conformation of finger and exo |
| F360W | closed conformation of finger and exo |
| F360H | closed conformation of finger and exo |
| F363A | closed conformation of finger and exo |
| F363H | closed conformation of finger and exo |
| F363W | closed conformation of finger and exo |
| I370W | closed conformation of finger and exo |
| I370H | closed conformation of finger and exo |
| K371A | closed conformation of finger and exo |
| K371W | closed conformation of finger and exo |
| I378H | closed conformation of finger and exo |
| I378W | closed conformation of finger and exo |
| L381W | closed conformation of finger and exo |
| L381H | closed conformation of finger and exo |
| K383N | closed conformation of finger and exo |
| K383A | closed conformation of finger and exo |
| L389A | closed conformation of finger and exo |
| L389W | closed conformation of finger and exo |
| L389H | closed conformation of finger and exo |
| F393A | closed conformation of finger and exo |
| F393W | closed conformation of finger and exo |
| F393H | closed conformation of finger and exo |

TABLE 1-continued

| Mutation | Rationale |
|---|---|
| I433A | closed conformation of finger and exo |
| I433W | closed conformation of finger and exo |
| I433H | closed conformation of finger and exo |
| K383L | phosphate backbone interaction |
| K383H | phosphate backbone interaction |
| K383R | phosphate backbone interaction |
| Q380R | phosphate backbone interaction |
| Q380H | phosphate backbone interaction |
| Q380K | phosphate backbone interaction |
| K371L | phosphate backbone interaction |
| K371H | phosphate backbone interaction |
| K371R | phosphate backbone interaction |
| K379L | phosphate backbone interaction |
| K379H | phosphate backbone interaction |
| K379R | phosphate backbone interaction |
| E486A | phosphate backbone interaction |
| E486D | phosphate backbone interaction |
| N387L | incoming nucleotide base and translocation |
| N387F | incoming nucleotide base and translocation |
| N387V | incoming nucleotide base and translocation |
| N251H | phosphate interaction |
| N251Q | phosphate interaction |
| N251D | phosphate interaction |
| N251E | phosphate interaction |
| N251K | phosphate interaction |
| N251R | phosphate interaction |
| A484K | phosphate interaction |
| A484R | phosphate interaction |
| K383Q | phosphate interaction |
| K383N | phosphate interaction |
| K383T | phosphate interaction |
| K383S | phosphate interaction |
| K383A | phosphate interaction |
| I179H/I378H | closed conformation |
| I179W/I378W | closed conformation |
| I179Y/I378Y | closed conformation |
| K478L | |
| I378Y | |
| I370A | |
| I179Y | |
| N387L/A484E | |
| N387L/A484Y | |
| T372Q/N387L/A484E | |
| T372Q/N387L/A484Y | |
| T372L/N387L/A484E | |
| T372L/N387L/K478Y/A484Y | |
| T372Y/N387L/K478Y/A484E | |
| T372Y/N387L/K478Y/A484Y | |

Table 2 presents exemplary Φ29 mutants that exhibit two slow step behavior under appropriate reaction conditions. The first three modified polymerases exhibit the most pronounced two slow step behavior, followed by the next six. As noted, the polymerases are optionally exonuclease-deficient; for example, they can also include an N62D substitution.

TABLE 2

A484E/E375Y/K512Y/T368F
A484Y/E375Y/K512Y/T368F
N387L/E375Y/K512Y/T368F
T372Q/E375Y/K512Y/T368F
T372L/E375Y/K512Y/T368F
T372Y/K478Y/E375Y/K512Y/T368F
I370W/E375Y/K512Y/T368F
F198W/E375Y/K512Y/T368F
L381A/E375Y/K512Y/T368F
E375Y/K512Y/T368F

Additional exemplary recombinant polymerases, including polymerases that exhibit two slow step behavior under appropriate reaction conditions, are presented herein, e.g., in Table 3, Table 13, and FIG. 34. Additional exemplary mutations of interest, e.g., for slowing a reaction rate or achieving two slow step behavior, are included in Table 4, Table 13, and FIG. 34. As noted for other exemplary mutations herein, essentially any of the mutations listed in Tables 3, 4, 13 and 14, or any combination thereof, can be introduced into a polymerase to produce a modified recombinant polymerase; for example, into wild-type Φ29, a wild-type or exonuclease deficient Φ29-type polymerase (e.g., including an N62D substitution), and/or E375Y/K512Y/T368F, E375Y/K512Y/T368F/A484E, E375Y/K512Y/A484E, or E375Y/K512Y/T368G/A484E Φ29, as just a few examples. Also, as for the other exemplary mutations herein, a polymerase comprising one or more of the mutations listed in Tables 3, 4, 13, and 14 optionally also includes one or more tags, for example, a biotin attachment site or polyhistidine tag. As just one example, the polymerase optionally includes an N-terminal biotin attachment site followed by a His10 polyhistidine tag and/or a C-terminal His10 tag. Exemplary exogenous or heterologous features that can be added to recombinant polymerases are provided in Table 10.

TABLE 3

Exemplary Φ29 polymerases. Entries marked with an asterisk (*) have been demonstrated to display two slow step behavior in transient kinetic assays, e.g., as described hereinbelow in Example 2. The remaining exemplary polymerases are also thought to have two slow step properties, based on their behavior in a Cbz assay (e.g., as described hereinbelow in Example 4) where greater inhibition of the polymerases by Cbz indicates stronger binding of product and therefore slower product release.

T368F_E375Y_K512Y_K529N
T368F_E375Y_K512Y_T573A
T368F_T372Q_E375Y_K512Y*
T368F_T372L_E375Y_K512Y*
T368F_T372Y_E375Y_K478Y_K512Y*
T368F_E375Y_A484Y_K512Y*
T368F_E375Y_N387L_K512Y
T368F_E375Y_L389W_K512Y
T368F_E375Y_Q380K_K512Y
T368F_E375Y_Q380R_K512Y
T368F_E375Y_Q380D_K512Y
T368F_E375Y_N387F_K512Y
T368F_E375Y_N387W_K512Y
T189K_T368F_E375Y_K512Y
T368F_E375Y_K512Y_F572K
T368F_E375Y_A484E_S487E_K512Y
T368F_T372Q_E375Y_A484E_K512Y*
T368F_T372L_E375Y_A484E_K512Y*
T368F_T372Y_E375Y_K478Y_A484E_K512Y*
T368F_T372L_E375Y_K478Y_A484Y_K512Y*
T368F_T372L_E375Y_N387L_K478Y_A484Y_K512Y*
T368F_T372Y_E375Y_N387L_K478Y_A484Y_K512Y*
T368F_E375Y_A484E_K512Y*

TABLE 4

| Exemplary mutations and combinations. | |
|---|---|
| Mutation | Rationale |
| T372L | |
| N251K | |
| S215D_T368F_E375Y_K512Y | |
| T368F_T372L_E375Y_K478Y_K512Y | |
| D249E_T368F_E375Y_A484E_K512Y | |
| T368F_E375Y_K512Y | |
| T368F_E375Y_Q380K_K512Y | |
| T368F_E375Y_I378W_K512Y | |
| T368F_E375Y_A484Q_K512Y | |
| T368F_E375Y_A484E_K512Y | |
| T368F_E375Y_K379R_A484E_K512Y | |
| T368F_E375Y_A484K_K512Y | |
| T368F_E375Y_A484R_K512Y | |
| T368F_E375Y_S395K_K512Y | |
| T368F_E375Y_S459D_A484E_K512Y | |
| T368F_E375Y_S459E_A484E_K512Y | |
| T368F_E375Y_A484E_S487D_K512Y | |
| T368F_E375Y_P477D_K512Y | |
| N251Q_T368F_E375Y_K512Y | |
| T368F_T372Q_E375Y_A484Y_K512Y | |
| T368F_T372L_E375Y_A484Y_K512Y | |
| T368F_E375Y_A484K_K512Y | |
| T368F_E375Y_A484R_K512Y | |
| T368F_E375Y_N387L_A484E_K512Y | |
| T368F_T372Q_E375Y_N387L_A484E_K512Y | |
| T368F_T372Q_E375Y_N387L_A484Y_K512Y | |
| T368F_T372L_E375Y_N387L_A484E_K512Y | |
| T368F_T372Y_E375Y_N387L_K478Y_A484E_K512Y | |
| I93F_T368F_E375Y_A484E_K512Y | |
| I93Y_T368F_E375Y_A484E_K512Y | |
| T368F_E375Y_S395K_A484E_K512Y | |
| T368F_E375Y_V399F_A484E_K512Y | |
| T368F_E375Y_V399Y_A484E_K512Y | |
| I364D_T368F_E375Y_N387L_A484E_K512Y | |
| T368F_E375Y_N387L_A484E_K512Y | |
| N251K_T368F_E375Y_K512Y | |
| N251Q_T368F_E375Y_K512Y | |
| T368F_E375Y_P477K_K512Y | |
| T368F_E375Y_P477D_K512Y | |
| T368F_T372Q_E375Y_A484Y_K512Y | |
| T368F_T372L_E375Y_A484E_K512Y | |
| T368F_T372L_E375Y_A484Y_K512Y | |
| T368F_T372Y_E375Y_K478Y_A484E_K512Y | |
| T368F_T372L_E375Y_K478Y_A484Y_K512Y | |
| T368F_E375Y_A484K_E486K_K512Y | |
| T368F_E375Y_A484R_E486R_K512Y | |
| T368F_E375Y_A484R_E486R_K512Y_E515R | |
| T368F_E375Y_A484K_E486K_K512Y_E515K | |
| E375Y_A484E_K512Y | |
| E375Y_I378K_A484E_K512Y | |
| T368G_E375Y_A484E_K512Y | |
| T15I_T368F_E375Y_N387L_A484E_K512Y | |
| T15I_T368F_E375Y_A484E_K512Y | |
| N313K_T368F_E375Y_A484E_Q497K_K512Y | |
| P300E_Y315L_T368F_E375Y_A484E_K512Y | |
| P300G_Y315V_T368F_E375Y_A484E_K512Y | |
| N62H_T368F_E375Y_N387L_A484E_K512Y | |
| N62H_T368F_E375Y_A484E_K512Y | |
| T368F_E375Y_A484E_K512Y | |
| T368F_E375Y_S395K_Q497K_K512Y | |
| M188K_T368F_E375Y_S395K_Q497K_K512Y_T534K | |
| T368F_E375Y_S395K_Q497K_K512Y | |
| M188K_T368F_E375Y_S395K_Q497K_K512Y_T534K | |
| T368F_E375Y_Q380K_Q497K_K512Y | |
| T368F_E375Y_P477D_Q497K_K512Y | |
| T368F_E375Y_Q380K_Q497K_K512Y | |
| T368F_E375Y_P477D_Q497K_K512Y | |
| T368F_E375Y_Q380K_A484E_Q497K_K512Y | |
| T368F_E375Y_P477D_A484E_Q497K_K512Y | |
| T368F_E375Y_A484E_Q497K_K512Y | |
| M188K_T368F_E375Y_A484E_Q497K_K512Y | |
| T368F_E375Y_S395K_A484E_Q497K_K512Y | |
| T368F_E375Y_A484E_Q497K_K512Y_T534K | |
| M188K_T368F_E375Y_S395K_A484E_Q497K_K512Y_T534K | |
| T372Q_E375Y_A484E_K512Y | |
| T372L_E375Y_A484E_K512Y | |

TABLE 4-continued

| Exemplary mutations and combinations. | |
|---|---|
| Mutation | Rationale |
| T372Y_E375Y_K478Y_A484E_K512Y | |
| T368F_E375Y_Q380K_K512Y | |
| T368F_E375Y_A484E_S487E_K512Y | |
| Q183S_E375Y_A484E_K512Y | |
| Q183S_T368F_E375Y_A484E_K512Y | |
| L253A_E375Y_A484E_K512Y | |
| L253A_T368F_E375Y_A484E_K512Y | |
| P129D_T368F_E375Y_A484E_K512Y | |
| T189D_T368F_E375Y_A484E_K512Y | |
| T203D_T368F_E375Y_A484E_K512Y | |
| S252D_T368F_E375Y_A484E_K512Y | |
| S329D_T368F_E375Y_A484E_K512Y | |
| N330D_T368F_E375Y_A484E_K512Y | |
| F360D_T368F_E375Y_A484E_K512Y | |
| K361D_T368F_E375Y_A484E_K512Y | |
| T368F_E375Y_T427D_A484E_K512Y | |
| T372Y_E375Y_A484E_K512Y | |
| K361N_E375Y_W436Y_A484E_K512Y_V514G | |
| N62H_T368Y_E375Y_A484Q_K512Y | |
| E375Y_A484Q_K512Y | |
| S215D_T368F_E375Y_A484E_K512Y | |
| T368F_E375Y_I378W_A484E_K512Y | |
| S215D_T368F_E375Y_I378W_A484E_K512Y | |
| S215D_T372Q_E375Y_I378W_A484E_K512Y | |
| D12K_T368F_E375Y_A484E_K512Y | |
| D12R_T368F_E375Y_A484E_K512Y | |
| D12M_T368F_E375Y_A484E_K512Y | |
| D66K_T368F_E375Y_A484E_K512Y | |
| D66R_T368F_E375Y_A484E_K512Y | |
| D66M_T368F_E375Y_A484E_K512Y | |
| D12A_E375Y_P477D_A484E_K512Y | |
| D12A_D66A_T368F_E375Y_P477D_A484E_K512Y | |
| T368F_E375Y_A484E_511.1G_511.2S_K512Y_512.1G_512.2S | |
| T368F_E375Y_A484E_507.1E_507.2V_507.3D_507.4G_507.5Y_K512Y | |
| T368F_E375Y_A484E_511.1G_511.2S_512.1G_512.2S | |
| T368F_E375Y_A484E_511.1K_511.2S_512.1G_512.2S | |
| F198W_T368F_I370W_T372Q_E375Y_A484E_K512Y | |
| F198W_T368F_I370W_T372Q_E375Y_I378W_A484E_K512Y | |
| F198W_S215D_T368F_I370W_T372Q_E375Y_A484E_K512Y | |
| F198W_S215D_T368F_I370W_T372Q_E375Y_I378W_A484E_K512Y | |
| F198W_S215D_T368F_I370W_T372Q_I378W_E375Y_P455D_A484E_K512Y | |
| T368F_E375Y_P477D_A484E_K512Y | |
| T368F_E375Y_P477K_A484E_K512Y | |
| T368F_E375Y_P477Q_A484E_K512Y | |
| N251Q_T368F_E375Y_A484E_K512Y | |
| T368F_E375Y_A484E_Q497K_K512Y_K575A | |
| T368F_E375Y_L381E_A484E_K512Y | |
| T368F_E375Y_N387M_A484E_K512Y | |
| T368F_E375Y_L381E_N387M_A484E_K512Y | |
| T368F_E375Y_L384R_A484E_K512Y | |
| T368F_E375Y_L384R_N387M_A484E_K512Y | |
| T368F_E375Y_A484E_K512Y_K575A | |
| T368F_E375Y_A484E_K512Y_K555A | |
| T368F_E375Y_V399Y_A484E_Q497K_K512Y_K575A | |
| I93Y_T368F_E375Y_A484E_Q497K_K512Y_K575A | |
| T368F_E375Y_S395K_A484E_Q497K_K512Y_K575A | |
| I170F_E375Y_A484E_K512Y | |
| I170R_E375Y_A484E_K512Y | |
| A176E_E375Y_A484E_K512Y | |
| A176T_E375Y_A484E_K512Y | |
| A176V_E375Y_A484E_K512Y | |
| Q180L_E375Y_A484E_K512Y | |
| F181P_E375Y_A484E_K512Y | |
| K182P_E375Y_A484E_K512Y | |
| Q183D_E375Y_A484E_K512Y | |
| Q183K_E375Y_A484E_K512Y | |
| L185D_E375Y_A484E_K512Y | |
| L185K_E375Y_A484E_K512Y | |
| A190E_E375Y_A484E_K512Y | |
| A190F_E375Y_A484E_K512Y | |
| A190L_E375Y_A484E_K512Y | |
| A190P_E375Y_A484E_K512Y | |
| A190T_E375Y_A484E_K512Y | |
| A190V_E375Y_A484E_K512Y | |
| G191A_E375Y_A484E_K512Y | |
| G191P_E375Y_A484E_K512Y | |

TABLE 4-continued

| Exemplary mutations and combinations. | |
|---|---|
| Mutation | Rationale |
| L253E_E375Y_A484E_K512Y | |
| K361P_E375Y_A484E_K512Y | |
| D365E_E375Y_A484E_K512Y | |
| D365P_E375Y_A484E_K512Y | |
| E375Y_L381F_A484E_K512Y | |
| E375Y_L381K_A484E_K512Y | |
| E375Y_L381R_A484E_K512Y | |
| E375Y_S388A_A484E_K512Y | |
| E375Y_E508R_A484E_K512Y | |
| E375Y_E508V_A484E_K512Y | |
| E375Y_A484E_K512Y_D523F | |
| E375Y_A484E_K512Y_D523L | |
| E375Y_A484E_K512Y_D523R | |
| E375Y_A484E_Q497K_K512Y | |
| E375Y_A484K_Q497K_K512Y | |
| T368F_E375Y_E420R_A484E_K512Y | |
| T368F_E375Y_E420M_A484E_K512Y | |
| E375Y_L384M_A484E_K512Y | |
| E375Y_E420R_A484E_K512Y | |
| E375Y_E420M_A484E_K512Y | |
| E375Y_P477E_A484E_K512Y | |
| E375Y_P477K_A484E_K512Y | |
| E375Y_P477Q_A484E_K512Y | |
| N251Q_E375Y_A484E_K512Y | |
| E375Y_A484E_Q497K_K512Y_K575A | |
| E375Y_L381E_A484E_K512Y | |
| E375Y_N387M_A484E_K512Y | |
| E375Y_L381E_N387M_A484E_K512Y | |
| E375Y_L384R_A484E_K512Y | |
| E375Y_L384R_N387M_A484E_K512Y | |
| E375Y_A484E_K512Y_K575A | |
| E375Y_A484E_K512Y_K555A | |
| E375Y_K392A_A484E_K512Y | |
| E375Y_V399Y_A484E_Q497K_K512Y_K575A | |
| I93Y_E375Y_A484E_Q497K_K512Y_K575A | |
| E375Y_S395K_A484E_Q497K_K512Y_K575A | |
| T368F_E375Y_P477E_A484E_K512Y | |
| T368F_E375Y_P477K_A484E_K512Y | |
| T368F_E375Y_P477Q_A484E_K512Y | |
| N251Q_T368F_E375Y_A484E_K512Y | |
| T368F_E375Y_A484E_Q497K_K512Y_K575A | |
| T368F_E375Y_L381E_A484E_K512Y | |
| T368F_E375Y_N387M_A484E_K512Y | |
| T368F_E375Y_L381E_N387M_A484E_K512Y | |
| T368F_E375Y_L384R_A484E_K512Y | |
| T368F_E375Y_L384R_N387M_A484E_K512Y | |
| T368F_E375Y_A484E_K512Y_K575A | |
| T368F_E375Y_A484E_K512Y_K555A | |
| T368F_E375Y_K392A_A484E_K512Y | |
| T368F_E375Y_V399Y_A484E_Q497K_K512Y_K575A | |
| I93Y_T368F_E375Y_A484E_Q497K_K512Y_K575A | |
| T368F_E375Y_S395K_A484E_K512Y_K575A | |
| T368F_E375Y_K392R_A484E_K512Y | |
| T368F_E375Y_K422R_A484E_K512Y | |
| T368F_E375Y_K392M_A484E_K512Y | |
| T368F_E375Y_K392W_A484E_K512Y | |
| T368F_E375Y_K422M_A484E_K512Y | |
| T368F_E375Y_K422W_A484E_K512Y | |
| T368F_E375Y_A484E_K512Y | |
| S215D_T368F_T372Q_E375Y_I378W_A484E_K512Y | |
| D66K_T368F_E375Y_A484E_K512Y | |
| D66R_T368F_E375Y_A484E_K512Y | |
| D66M_T368F_E375Y_A484E_K512Y | |
| D12A_D66A_T368F_E375Y_P477D_K512Y | |
| D12A_D66A_T368F_E375Y_P477D_A484E_K512Y | |
| T368F_E375Y_A484E_511.1K_511.2S_512.1G_512.2K | |
| E375Y_N251K_A484E_K512Y | |
| E375Y_K422A_A484E_K512Y | |
| E375Y_Y390A_A484E_K512Y | |
| E375Y_Q303K_A484E_K512Y | |
| E375Y_N313K_A484E_K512Y | |
| E375Y_A484E_K512Y_D570K | |
| T368F_E375Y_L384M_A484E_K512Y | |
| E375Y_P477D_A484E_K512Y | |
| T368F_E375Y_P477D_A484E_K512Y | |
| T368F_E375Y_S395K_A484E_Q497K_K512Y_K575A | |

TABLE 4-continued

| Exemplary mutations and combinations. | |
|---|---|
| Mutation | Rationale |
| F137N_E375Y_I378K_A484E_K512Y | |
| P300E_Y315L_E375Y_A484E_K512Y | |
| P300G_Y315V_E375Y_A484E_K512Y | |
| E375Y_A484E_K512Y | |
| N62H_E375Y_A484E_K512Y | |
| E375Y_A484E_E508R_K512Y | |
| T372Q_E375Y_A484E_E508R_K512Y | |
| P300E_Y315L_T372Q_E375Y_A484E_K512Y | |
| T204E_E375Y_A484E_E508R_K512Y | |
| P300E_Y315L_E375Y_A484E_K512Y | |
| P477D | pyrophosphate release |
| P477K | pyrophosphate release, phosphate interaction |
| V399F | processivity |
| V399Y | processivity |
| Q380D | phosphate interaction |
| N251R | pyrophosphate release |
| L567R | translocation/template interactions |
| Q380R | phosphate interaction |
| F572K | template |
| N387F | |
| N387W | |
| T189K | |
| S487E | metal coordination |
| K529N | |
| T573A | |
| N387L | |
| L389W | |
| A484Y | |
| F198W | |
| I370W | |
| I378S | |
| C455D | |
| A484Q | |
| T368G_E375Y_A484E_K512Y | |
| E375Y_A484E_K512Y | |
| A484E S487E | metal coordination |
| V247E S459D A484E | metal coordination |
| S459D A484E | metal coordination |
| S459D | metal coordination |
| V247E | metal coordination |
| V247E S459E A484E | metal coordination |
| S459E A484E | metal coordination |
| S459E | metal coordination |
| A484E S487D | metal coordination |
| S487D | metal coordination |
| Q380K | phosphate interaction |
| Q380H | phosphate interaction |
| Q380E | phosphate interaction |
| A486A | phosphate interaction |
| A486K | phosphate interaction |
| A486R | phosphate interaction |
| A486M | phosphate interaction |
| A484K | phosphate interaction |
| A484R | phosphate interaction |
| A484M | phosphate interaction |
| E515K | phosphate interaction |
| E515R | phosphate interaction |
| P477R | phosphate interaction |
| D12A D66A T368F E375Y A484E K512Y | |
| T368F E375Y G511.1G K512Y K512.1G | dye interaction |
| G511 G511.1G 511.2S K512Y K512.1G 512.2S | dye interaction |
| G511 G511.1E 511.2V 511.3D 511.4G K512Y | dye interaction |
| L253A T368F E375Y K512Y | |
| I179W T368F E375Y K512Y | |
| T368F I370H E375Y K512Y | |
| Y101K | translocation |
| M188K | translocation |
| T189K | translocation |
| Q303K | translocation |
| N313K | translocation |
| S395K | translocation |
| F414K | translocation |
| Q497K | translocation |
| Y500K | translocation |

TABLE 4-continued

Exemplary mutations and combinations.

| Mutation | Rationale |
| --- | --- |
| A531K | translocation |
| G532K | translocation |
| T534K | translocation |
| P558K | translocation |
| D570K | translocation |
| F572K | translocation |
| I574K | translocation |
| K64A | translocation |
| K305A | translocation |
| K392A | translocation |
| K402A | translocation |
| K422A | translocation |
| R496A | translocation |
| K529A | translocation |
| K538A | translocation |
| K555A | translocation |
| K575A | translocation |
| N251K | pyrophosphate release |
| N251Q | pyrophosphate release |
| N251D | pyrophosphate release |
| P477Q | pyrophosphate release |
| P477E | pyrophosphate release |
| P477R | pyrophosphate release |
| P477H | pyrophosphate release |

Compositions, kits, and systems (e.g., sequencing systems) including the modified recombinant polymerases with decreased rate constants are features of the invention, as are methods employing the modified recombinant polymerases (e.g., methods of sequencing or making DNA). Methods for generating recombinant polymerases are also featured, as described in greater detail below, as are the resulting polymerases. Thus, one aspect provides a modified recombinant Φ29-type DNA polymerase comprising one or more mutations (e.g., amino acid substitutions or insertions) relative to a parental polymerase at one or more positions selected from the group consisting of: a) positions that form a binding site for a metal ion that interacts with an epsilon and/or digamma phosphate of a bound nucleotide analog having five or more phosphate groups; b) positions 372-397 and 507-514; c) positions that form a binding site for a terminal fluorophore on a phosphate-labeled nucleotide analog, particularly hexaphosphate analogs; d) positions at an intramolecular interface in a closed conformation of a ternary complex comprising the polymerase, a DNA, and a nucleotide or nucleotide analog; e) positions that form a binding site for a polyphosphate group of a bound nucleotide or nucleotide analog; f) positions that interact with the base of a bound nucleotide or nucleotide analog; and g) positions that interact with a bound DNA; wherein numbering of positions is relative to wild-type Φ29 polymerase. Preferably, the one or more mutations comprise at least one mutation other than a 514Y, 514W, 514F, 514I, 514K, 259S, 370V, 370K, 372D, 372E, 372R, 372K, 372N, 372L, 387A, 387D, 478D, 478E, 478R, 480K, 480M, 480R, 371Q, 379E, 379T, 486D, 486A, 188A, 188S, 254F, 254V, 254A, 390F, or 390A substitution. The modified polymerase optionally exhibits a decreased first rate constant, balanced first and second rate constants, and the like as for the embodiments described above.

A number of relevant positions and mutations are described herein. For example, the modified polymerase can comprise at least one amino acid substitution at at least one residue selected from the group consisting of positions 484, 249, 179, 198, 211, 255, 259, 360, 363, 365, 370, 372, 378, 381, 383, 387, 389, 393, 433, 478, 480, 514, 251, 371, 379, 380, 383, 458, 486, 101, 188, 189, 303, 313, 395, 414, 497, 500, 531, 532, 534, 558, 570, 572, 574, 64, 305, 392, 402, 422, 496, 529, 538, 555, 575, 254, and 390. Exemplary modified polymerases include those with at least one amino acid substitution or combination of substitutions selected from the group consisting of: an amino acid substitution at position 484; an amino acid substitution at position 198; an amino acid substitution at position 381; A484E; A484Y; N387L; T372Q; T372Y; T372Y and K478Y; K478Y; I370W; F198W; L381A; T368F; A484E, E375Y, K512Y, and T368F; A484Y, E375Y, K512Y, and T368F; N387L, E375Y, K512Y, and T368F; T372Q, E375Y, K512Y, and T368F; T372L, E375Y, K512Y, and T368F; T372Y, K478Y, E375Y, K512Y, and T368F; I370W, E375Y, K512Y, and T368F; F198W, E375Y, K512Y, and T368F; L381A, E375Y, K512Y, and T368F; and E375Y, K512Y, and T368F, as well as others described herein. As another example, the modified polymerase can include an insertion of at least one amino acid (e.g., 1-7 amino acids, e.g., glycine) within residues 372-397 and/or 507-514 (e.g., after residue 374, 375, 511, and/or 512). Additional exemplary mutations and mutation combinations are provided herein, e.g., in Tables 13 and 16 and FIGS. 34-35.

As will be appreciated, recombinant polymerases that exhibit slow steps can also include additional mutations (e.g., amino acid substitutions, deletions, insertions, exogenous features at the N- and/or C-terminus, and/or the like) which confer one or more additional desirable properties, e.g., reduced or eliminated exonuclease activity, increased closed complex stability, reduced or increased branching, selectivity for particular metal cofactors, increased yield, increased thermostability, increased accuracy, increased speed, and/or increased readlength.

Polymerase Reaction Conditions

Recombinant polymerases of the invention are optionally modified in a manner in which the relative rates of steps of the polymerization reaction are changed, for example, such that the polymerase is capable of showing two slow step characteristics. The reaction conditions can also affect reaction rates. Reaction conditions can thus be manipulated, for example, to further slow a step or steps which are already slowed in a modified polymerase, or to slow an additional step, such that the resulting polymerase system exhibits two slow step behavior.

The polymerase reaction conditions include, e.g., the type and concentration of buffer, the pH of the reaction, the temperature, the type and concentration of salts, the presence of particular additives which influence the kinetics of the enzyme, and the type, concentration, and relative amounts of various cofactors, including metal cofactors. Manipulation of reaction conditions to achieve or enhance two slow step behavior of polymerases is described in detail in U.S. patent application Ser. No. 12/414,191 filed Mar. 30, 2009, and entitled "Two slow-step polymerase enzyme systems and methods."

Enzymatic reactions are often run in the presence of a buffer, which is used, in part, to control the pH of the reaction mixture. The type of buffer can in some cases influence the kinetics of the polymerase reaction in a way that can lead to two slow-step kinetics. For example, in some cases, use of TRIS as buffer is useful for obtaining a two slow-step reaction. Suitable buffers include, for example, TAPS (3-{[tris(hydroxymethyl)methyl]amino}propanesulfonic acid), Bicine (N,N-bis(2-hydroxyethyl)glycine), TRIS (tris(hydroxymethyl)methylamine), ACES (N-(2-Acetamido)-2-aminoethanesulfonic acid), Tricine (N-tris(hydroxymethyl)methylglycine), HEPES 4-2-hydroxyethyl-1-piperazineethanesulfonic acid), TES (2-{[tris(hydroxymethyl)methyl]amino}ethanesulfonic acid), MOPS (3-(N-morpholino)propanesulfonic acid), PIPES (piperazine-N,N'-bis(2-ethanesulfonic acid)), and MES (2-(N-morpholino)ethanesulfonic acid).

The pH of the reaction can influence the kinetics of the polymerase reaction, and can be used as one of the polymerase reaction conditions to obtain a reaction exhibiting two slow-step kinetics. The pH can be adjusted to a value that produces a two slow-step reaction mechanism. The pH is generally between about 6 and about 9. In some cases, the pH is between about 6.5 and about 8.0. In some cases, the pH is between about 6.5 and 7.5. In some cases, the pH is about 6.5, 6.6, 6.7, 6.8, 6.9, 7.0, 7.1, 7.2, 7.3, 7.4, or 7.5.

The temperature of the reaction can be adjusted in order to obtain a reaction exhibiting two slow-step kinetics. The reaction temperature may depend upon the type of polymerase which is employed. For example, temperatures between 15° C. and 90° C., between 20° C. and 50° C., between 20° C. and 40° C., or between 20° C. and 30° C. can be used.

In some cases, additives can be added to the reaction mixture that will influence the kinetics of the polymerase reaction in a manner that can lead to two slow-step kinetics. In some cases, the additives can interact with the active site of the enzyme, acting for example as competitive inhibitors. In some cases, additives can interact with portions of the enzyme away from the active site in a manner that will influence the kinetics of the reaction so as to produce a reaction exhibiting two slow steps. Additives that can influence the kinetics include, for example, competitive but otherwise unreactive substrates or inhibitors in analytical reactions to modulate the rate of reaction as described in copending U.S. Utility patent application Ser. No. 12/370,472, the full disclosure of which is incorporated herein by reference in its entirety for all purposes.

As another example, an isotope such as deuterium can be added to influence the rate of one or more step in the polymerase reaction. In some cases, deuterium can be used to slow one or more steps in the polymerase reaction due to the deuterium isotope effect. By altering the kinetics of steps of the polymerase reaction, in some instances two slow step kinetics, as described herein, can be achieved. The deuterium isotope effect can be used, for example, to control the rate of incorporation of nucleotide, e.g., by slowing the incorporation rate. Isotopes other than deuterium can also be employed, for example, isotopes of carbon (e.g. $^{13}C$), nitrogen, oxygen, sulfur, or phosphorous.

As yet another example, additives that can be used to control the kinetics of the polymerase reaction include the addition of organic solvents. The solvent additives are generally water soluble organic solvents. The solvents need not be soluble at all concentrations, but are generally soluble at the amounts used to control the kinetics of the polymerase reaction. While not being bound by theory, it is believed that the solvents can influence the three dimensional conformation of the polymerase enzyme which can affect the rates of the various steps in the polymerase reaction. For example, the solvents can affect steps involving conformational changes such as the isomerization steps shown in FIG. 12. Added solvents can also affect, and in some cases slow, the translocation step. In some cases, the solvents act by influencing hydrogen bonding interactions.

The water miscible organic solvents that can be used to control the rates of one or more steps of the polymerase reaction in single molecule sequencing include, e.g., alcohols, amines, amides, nitriles, sulfoxides, ethers, and esters and small molecules having more than one of these functional groups. Exemplary solvents include alcohols such as methanol, ethanol, propanol, isopropanol, glycerol, and small alcohols. The alcohols can have one, two, three, or more alcohol groups. Exemplary solvents also include small molecule ethers such as tetrahydrofuran (THF) and dioxane, dimethylacetamide (DMA), dimethylsulfoxide (DMSO), dimethylformamide (DMF), and acetonitrile.

The water miscible organic solvent can be present in any amount sufficient to control the kinetics of the polymerase reaction. The solvents are generally added in an amount less than 40% of the solvent weight by weight or volume by volume. In some embodiments the solvents are added between about 0.1% and 30%, between about 1% and about 20%, between about 2% and about 15%, and between about 5% and 12%. The effective amount for controlling the kinetics can be determined by the methods described herein and those known in the art.

One aspect of controlling the polymerase reaction conditions relates to the selection of the type, level, and relative amounts of cofactors. For example, during the course of the polymerase reaction, divalent metal co-factors, such as magnesium or manganese, will interact with the enzyme-substrate complex, playing a structural role in the definition of the active site. For a discussion of metal co-factor interaction in polymerase reactions, see, e.g., Arndt, et al., Biochemistry (2001) 40:5368-5375.

For example, and without being bound to any particular theory of operation, it is understood that metal cofactor binding in and around the active site serves to stabilize binding of incoming nucleotides and is required for subsequent catalysis, e.g., as shown in steps 106 and 108 of FIG. 12. Other metal cofactor binding sites in polymerases, e.g., in the exonuclease domains, are understood to contribute to different functionality of the overall proteins, such as exonuclease activity. Modulation, and particularly competitive modulation, of divalent metal cofactors to the synthesis reaction can provide substantial benefits in terms of reaction kinetics without a consequent increase in negative reaction events.

In the synthesis reaction, certain divalent or trivalent metal cofactors, such as magnesium and manganese, are known to interact with the polymerase to modulate the progress of the reaction (See, e.g., U.S. Pat. No. 5,409,811). Other divalent metal ions, such as $Ca^{2+}$, have been shown to interact with the polymerase, such as Φ29 derived polymerases, to negative effect, e.g., to halt polymerization. As will be appreciated, depending upon the nature of the polymerization reaction, environmental conditions, the polymerase used, the nucleotides employed, etc., different metal co-factors will have widely varying catalytic effects upon the polymerization reaction. In the context of the present invention, different metal co-factors will be referred to herein based upon their relative catalytic impact on the polymerization reaction, as compared to a different metal included under the same reaction conditions. For purposes of discussion, a first metal co-factor that interacts with the polymerase complex to support the polymerization reaction to a higher level than a second metal co-factor under the same conditions is termed a "catalytic metal ion" or "catalytic metal." In preferred aspects, such catalytic metals support the continued, iterative or processive polymerization of nucleic acids under the particular polymerase reaction conditions, e.g., through the addition of multiple bases, while in some cases, a given type of metal cofactor may only support addition of a single base. Such metals may be sufficiently catalytic, depending upon the specific application.

In certain cases, particularly preferred divalent metal ions or catalytic metals include, e.g., $Mn^{2+}$, and in some cases will include $Mg^{2+}$. Less preferred multivalent metal ions that may provide a sufficient level of catalytic activity depending upon the desired application include, e.g., zinc.

For purposes of the invention, metal ions that interact with the polymerase but that do not promote the polymerization reaction, and in many cases act to arrest or prevent polymerization, are termed "non-catalytic metals." Included among the non-catalytic metals for various polymerase systems are calcium, barium, strontium, iron, cobalt, nickel, tin, zinc, and europium. For example, these metals can be added to the polymerization reaction in salt form such as $Sr(OAc)_2$, $Sr(OAc)_2$, $CaCl_2$, $ZnCl_2$, $CaCl_2$, or $ZnSO_4$.

As described in detail in U.S. patent application Ser. No. 12/414,191 filed Mar. 30, 2009, and entitled "Two slow-step polymerase enzyme systems and methods," it has been discovered that mixtures of both catalytic and non-catalytic metal ions in the polymerization reaction mixture yields surprisingly beneficial results in this process. In particular, it has been observed that the competitive exchange rate for catalytic and non-catalytic metal ions in nucleic acid polymerases is sufficiently fast that one can exchange catalytic for non-catalytic ions in the reaction complex. Thus, these exchangeable catalytic and non-catalytic cofactors can be contacted with the polymerase complex to first sequester the nucleotide in a non-exchangeable state within the polymerase complex, from which it is substantially less likely to be released. Upon exchange of a non-catalytic cofactor with a catalytic co-factor, the nucleotide will be transitioned into an exchangeable state within the complex, from which it can proceed through an incorporation reaction. Further, the rate of the exchange is such that one can effectively modulate the speed of the polymerase reaction by modulating the relative proportion of catalytic/non-catalytic metal ions in the reaction mixture. In particular, modulating the relative concentrations of these ions effectively modulates the reaction kinetics of individual enzymes, rather than just in bulk. Furthermore, because the nature of the interaction of the complex with calcium ions interferes with both the forward progress of incorporation and the reverse progress of release or branching, one can effectively slow the reaction, or more specifically, increase the time the "to be incorporated" nucleotide is bound, without a consequent increase in the amount of nucleotide released or branching.

Thus, exemplary additives that can enhance control of kinetic behavior include non-catalytic metal ions, generally provided in a mixture of catalytic and non-catalytic metal ions. The molar ratio of catalytic to non-catalytic metals in the reaction mixture will generally vary depending upon the type of kinetic modulation desired for a given synthesis reaction, where slower incorporation would suggest higher levels of non-catalytic metal ions. Typically, such ratios of catalytic to non-catalytic metals in the reaction mixture will vary from about 10:1 to about 1:10, and preferably, from about 10:1 to about 1:5 (e.g., from about 5:1 to about 1:1 or about 2.5:1 to about 1.5:1), depending upon the desired level of modulation, the particular enzyme system employed, the catalytic and non-catalytic metal cofactors that are used, and the reaction conditions.

In addition to the presence of such metals at the ratios described herein, the absolute concentration of such metals in the reaction mixtures will typically range from about 0.1 mM to about 10 mM. For example, the reaction can include from about 0.25 mM $MnCl_2$ to about 1 mM $MnCl_2$ and from about 0.1 mM $CaCl_2$ to about 1.5 mM $CaCl_2$.

B. Exonuclease-Deficient Recombinant Polymerases

Many native DNA polymerases have a proof-reading exonuclease function which can yield substantial data analysis problems in processes that utilize real time observation of incorporation events as a method of identifying sequence information, e.g., single molecule sequencing applications. Even where exonuclease activity does not introduce such problems in single molecule sequencing, reduction of exonuclease activity can be desirable since it can increase accuracy (in some cases at the expense of readlength).

Accordingly, recombinant polymerases of the invention optionally include one or more mutations (e.g., substitutions, insertions, and/or deletions) relative to the parental polymerase that reduce or eliminate endogenous exonuclease activity. For example, relative to the wild-type Φ29 DNA polymerase, one or more of positions N62, D12, E14, T15, H61, D66, D169, K143, Y148, and H149 is optionally mutated to reduce exonuclease activity. Exemplary mutations that can reduce exonuclease activity include, e.g., N62D, N62H, D12A, T151, E141, E14A, D66A, K143D, D145A and D169A substitutions, as well as addition of an exogenous feature at the C-terminus (e.g., a polyhistidine tag). As an additional example, a Y148I substitution can modestly reduce exonuclease activity and provide some improvement in accuracy. Additional exemplary substitutions in the exonuclease domain include N62S, D12N, D12R, D12M, E14Q, H61K, H61D, H61A, D66R, D66N, D66Q, D66K, D66M, D169N, K143R, Y148K, Y148A, Y148C, Y148D, Y148E, Y148F, Y148G, Y148H, Y148L, Y148M, Y148N, Y148P, Y148Q, Y148R, Y148S, Y148T, Y148V, Y148W, and H149M. Additional exemplary mutations and/or combinations of mutations that can reduce or eliminate exonuclease activity can be found herein, e.g., in Table 13 and FIGS. 34 and 35. The polymerases of the invention optionally comprise one or more of these mutations. For example, in one aspect, the polymerase is a Φ29-type polymerase that includes one or more mutations in the N-terminal exonuclease domain (residues 5-189 as numbered with respect to wild-type Φ29).

C. Recombinant Polymerases with Increased Closed Complex Stability

In one aspect, the invention features methods of generating recombinant DNA polymerases with modifications that increase the stability of the closed polymerase/DNA complex, compositions that include such polymerases, and methods of using such modified polymerases to, e.g., sequence a DNA template or make a DNA. Any of a number of polymerases, e.g., those described herein or polymerases homologous to those described herein, can be modified to exhibit increased closed polymerase/DNA complex stability using the methods described herein. In a preferred embodiment, a Φ29 polymerase and Φ29 polymerase derivatives, e.g., exonuclease-deficient Φ29 mutants, Φ29-type polymerases, or polymerases homologous to Φ29, can be modified to exhibit this phenotype.

Figure 1A:
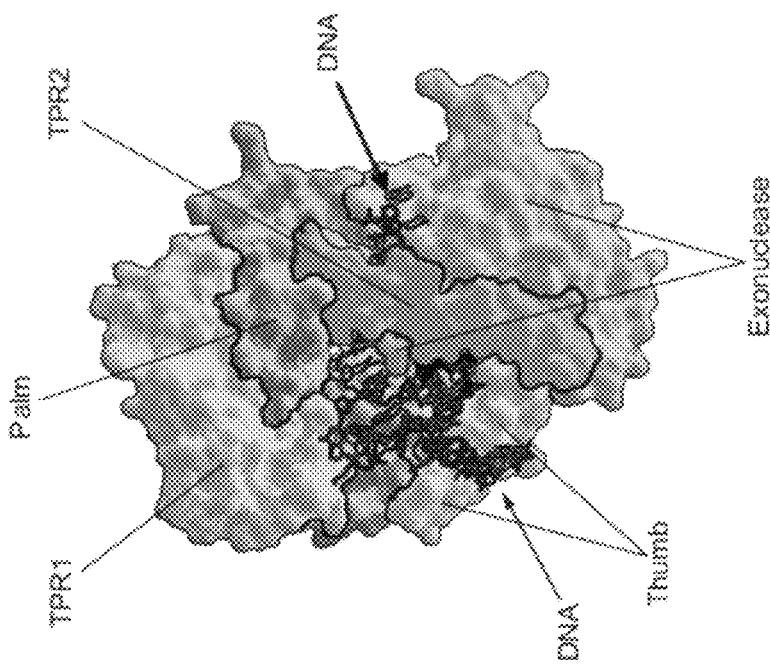
Figure 1B:
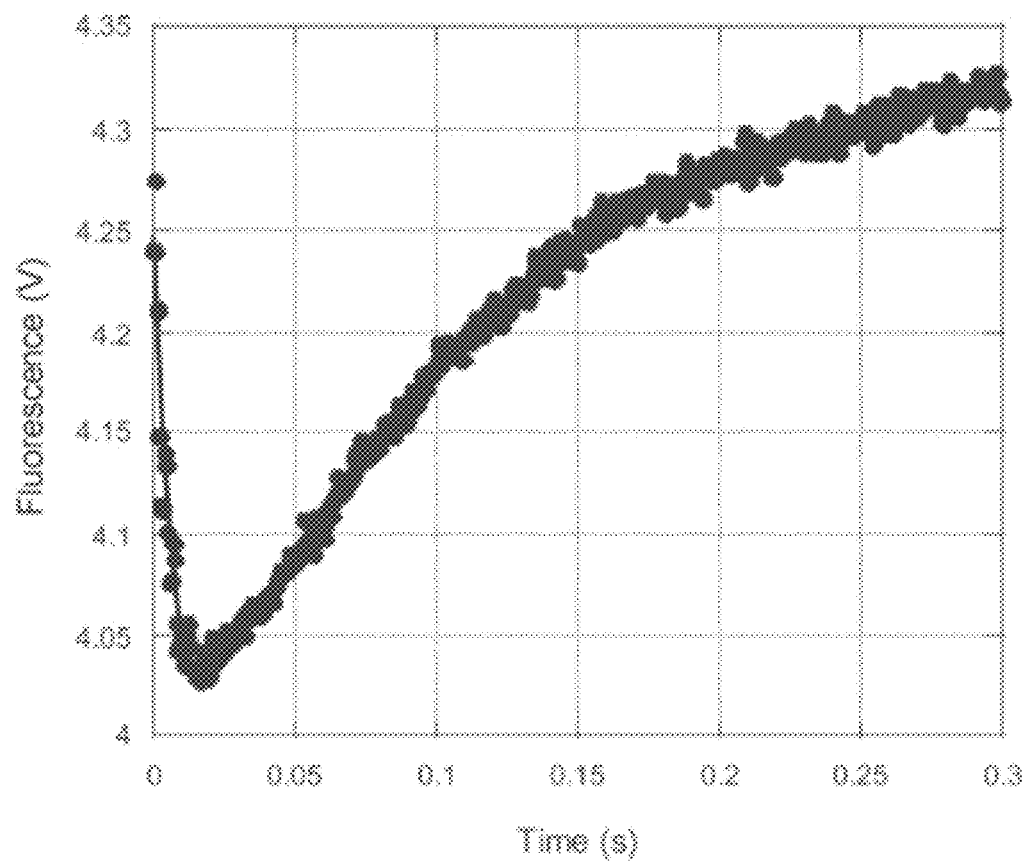

A closed polymerase/DNA complex is formed, e.g., by Φ29 DNA polymerase, when the Terminal Protein Region 2 (TPR2), exonuclease, thumb, and palm subdomains of Φ29 (FIG. 1 Panels A and B) encircle the DNA binding groove at the polymerization active site, forming a "doughnut" (FIG. 1 Panel B and FIG. 2 Panel A) around the upstream duplex DNA. This conformation enhances polymerase processivity in a manner analogous to sliding clamp proteins (Kamtekar, et al. (2004) "Insights into strand displacement and processivity from the crystal structure of the protein-primed DNA polymerase of bacteriophage phi29." Mol. Cell. 16: 1035-6). The other Φ29 subdomains represented in FIG. 1 include TPR1 and fingers. It is worth noting that closed complex formation can be independent of the presence of a nucleotide or nucleotide analog.

Φ29 DNA polymerase mutants lacking the TPR2 subdomain exhibit drastically decreased processivity (Rodriguez, et al. (2005) "A specific subdomain in Φ29 polymerase confers both processivity and strand-displacement capacity" Proc Natl Acad Sci USA 102: 6407-6412), indicating that mutations that stabilize the protein-protein interactions at the interface of these subdomains (FIG. 2 Panel B, example circled) can increase the stability of the closed complex comprising the polymerase and DNA, e.g., a template strand and a primer. An increase in closed polymerase/DNA complex stability can comprise an improvement of at least 30%, e.g., 50% or better, 75% or better, or even 100% or better.

Mutations that increase the stability of the closed polymerase/DNA complex can indirectly improve polymerase processivity and can generate polymerases that can be of beneficial use in any application where increased read length, speed, and accuracy of polymerization is desirable, e.g., single-molecule sequencing (SMS), e.g., in a zero-mode waveguide (ZMW), SNP genotyping using single base extension methods, real time monitoring of amplification, e.g., RT-PCR methods, and the like. Useful compositions comprising such polymerases can include nucleotide analogs, e.g., analogs labeled with fluorophores, phosphate-labeled nucleotide analogs, and/or labeled nucleotide analogs having, e.g., 3-7 phosphate groups, that the polymerase can incorporate into a DNA. In some embodiments of the compositions, a modified polymerase with improved closed polymerase/DNA complex stability can be immobilized on a surface, e.g., in a ZMW.

Figure 2B:
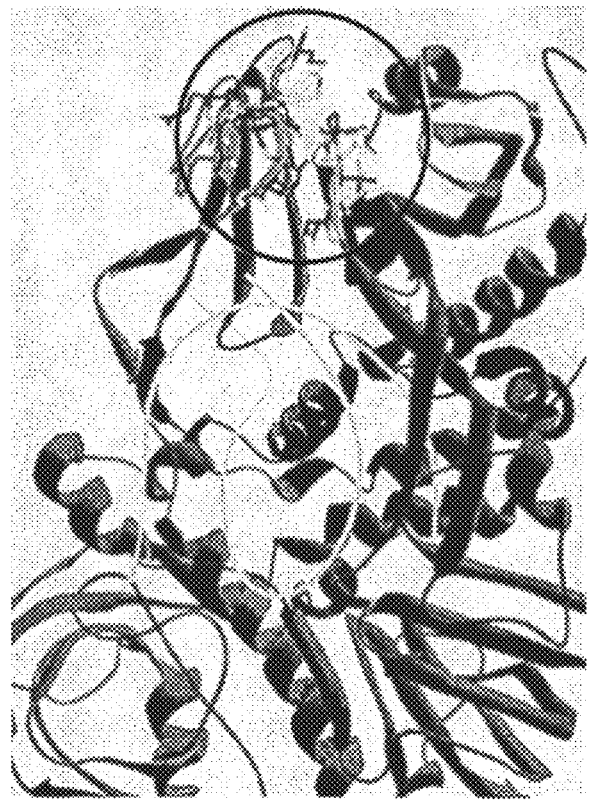
FIG. 2 Panels A and B depict the interface of the TPR2, thumb, and exonuclease subdomains of a Φ29 polymerase complexed with a DNA.
Figure 2A:

Mutations that can stabilize a closed polymerase/DNA complex include mutations to amino acids regions that correspond to Ala68-Arg76, Tyr405-Gly413, and Gln560-Gly564 of wild type Φ29. These amino acid regions comprise the interface of the exonuclease, TPR2, and thumb subdomains, respectively, and are depicted in FIG. 2 Panels A and B. Mutation of Thr92, in the exonuclease domain, can also stabilize interaction with TPR2 domain. Mutations can be introduced into one or more of these residues to provide additional stability to the closed complex, e.g., by stabilizing the interface of the exonuclease, TPR2, and thumb domains. For example, the hydrophobic environment between domains can be increased to increase complex stability, charged residues can be introduced to add favorable electrostatic interactions (or removed to remove unfavorable interactions), hydrogen bonds can be introduced, and the like. In general terms, a mutation can introduce an intramolecular interaction between domains that is predicted to stabilize the interface (and thus the closed complex) and/or can remove an interaction predicted to destabilize the interface. Thus, strategic mutations such as Thr92Phe, Thr92Ile, Gly410Asp, Asn72Ala, Asn72Ile, Asn72Phe, or Asn72Ser, or combinations thereof such as Thr92Ile and Gly104Asp, can stabilize a closed polymerase/DNA complex. Additional exemplary mutations and/or combinations of mutations that confer increased closed complex stability can be found herein, e.g., in Tables 13 and 16 and FIGS. 34-35. Strategies for mutating and screening polymerases are detailed herein.

Increases in the stability of a closed polymerase/DNA complex can be measured by comparing a rate of dissociation or the dissociation rate constant ($k_{off}$) of the modified polymerase from a DNA to $k_{off}$ of the parental polymerase from a DNA. Decreases in $k_{off}$ can correspond to an increase in closed complex stability. In one preferred embodiment, $k_{off}$ can be determined by, e.g., stopped-flow fluorometric analysis, incubating a fluorescently labeled DNA template, e.g., 2-aminopurine-labeled DNA, with a modified polymerase in the presence of an excess of competitor, e.g., unlabelled DNA or heparin. In another embodiment, a preformed complex comprising a modified polymerase and a template DNA can be incubated in the presence of excess competitor DNA or heparin. A time course of activity assays, e.g., primer extension, can measure the fraction of polymerase that remains associated with template. As indicated above, $k_{off}$ is optionally decreased by at least 30%, e.g., by at least 50%, at least 75%, or at least 100%, for the modified recombinant polymerase as compared to the parental polymerase.

Increases in the stability of a closed polymerase/DNA complex can also be measured by determining the equilibrium dissociation constant $K_d$, where a decrease in $K_d$ can correspond to increased closed complex stability. Optionally, $K_d$ is decreased by at least 30%, e.g., by at least 50%, at least 75%, or at least 100%, for the modified recombinant polymerase as compared to the parental polymerase. $K_d$ can be determined using techniques known in the art, for example, surface plasmon resonance (SPR), fluorescent anisotropy measurements, gel mobility shift assays, or isothermal titration calorimetry (ITC).

Processivity can be defined as the modified polymerase's extension rate constant ($k_{ext}$) divided by the sum of the extension rate constant and the rate constant for dissociation of the modified polymerase from a DNA ($k_{off}$), e.g., $k_{ext}/(k_{ext}+k_{off})$. As described herein, mutations in a polymerase that improve the stability of a closed polymerase/DNA complex can result in a measurable decrease in $k_{off}$, which can, accordingly, improve the polymerase's processivity, such that the modified polymerase's processivity is, e.g., at least twice that of the polymerase from which is was derived, or better. In a related aspect, a modified polymerase's processivity can be improved by increasing its extension rate, a phenotype which can be dependent on the type of nucleotide and/or nucleotide analog assayed. The extension rate constant can be determined using techniques known in the art. See, e.g., Korlach et al. (2008) "Long, processive enzymatic DNA synthesis using 100% dye-labeled terminal phosphate-linked nucleotides" Nucleosides Nucleotides Nucleic Acids 27(9):1072-83 (defined as $k_{el}$).

D. Recombinant Polymerases With Decreased Branching Fractions

During a polymerase kinetic cycle, sampling of each of the possible nucleotides or nucleotide analogs occurs until a correct Watson-Crick pairing is generated (see, e.g., Hanzel, et al. WO 2007/076057 POLYMERASES FOR NUCLEOTIDE ANALOGUE INCORPORATION for a description of the kinetic cycle of a polymerase; see also the section entitled "Polymerase Mediated Synthesis" above). According to structural studies of DNA polymerases complexed with DNA substrates, the primer-terminus can not typically form a covalent bond with an incorrectly paired nucleotide (Berman, et al. (2007) "Structures of phi29 polymerase complexed with substrate: the mechanism of translocation in polymerases." EMBO J 26: 3494-3505). Chemical linkages between a correctly paired nucleotide and the 3'OH of a preceding base can also fail to form, e.g., due to premature release of the sampled nucleotide from the active site. Sampling is then repeated for the same site, eventually resulting in the physical incorporation of the correct nucleotide. However, the premature release can be misread as an incorporation event by a readout system during, e.g., single molecule sequencing, e.g., where the system monitors residence time of the nucleotide analog at the active site as a proxy for incorporation; this can result in sequence read errors which include a nucleotide "insertion" relative to the correct sequence. This phenomenon is termed "branching" and can generate high error rates in single molecule sequencing, especially when chemically modified nucleotides or nucleotide analogs are used.

Among other aspects, the invention provides methods for generating recombinant polymerases that comprise modifications that reduce the frequency of branching, which can be useful in any number of applications where accuracy of polymerization is beneficial, e.g., high-throughput sequencing systems, e.g., in a zero-mode waveguide (ZMW), SNP genotyping using single base extension methods, real time monitoring of amplification, e.g., RT-PCR methods, and the like. Also provided are compositions that include such polymerases and methods in which these polymerases can be useful in, e.g., sequencing or making a DNA. In some embodiments, the compositions can also include a nucleotide analog, e.g., a phosphate-labeled nucleotide analog, an analog labeled with a fluorophore, and/or a nucleotide analog comprising from 3-7 phosphate groups, which can be incorporated into a copy nucleic acid by the modified polymerase in response to a DNA template. In some embodiments, the compositions can be present in a sequencing system, e.g. in a zero-mode waveguide, where a polymerase of the invention can optionally be immobilized on a surface.

Modification of a polymerase, e.g., any of the polymerases described herein, or polymerases homologous to those described herein, by any one or more of the strategies described herein can lower the frequency of these events by creating a more tightly structured binding pocket for non-native nucleotides. Modified polymerases can comprise at least one amino acid substitution or a combination of amino acid substitutions relative to the parental polymerase, such as those listed in Table 5. The modified polymerases can also comprise additional mutations, e.g., T368D, T368E, T368G, E375Y, E375W, K512Y, K512F, K512W, K512L, K512I, K512V, or K512H substitutions or other mutations described herein. In one embodiment, a polymerase that exhibits a reduced branching frequency can comprise at least one mutation that provides other useful features such as reduced exonuclease activity (e.g., N62D, D12A, D66A, and/or T151 substitutions relative to a wild-type Φ29 polymerase) or other properties described herein and/or at least one exogenous feature.

A number of specific examples of a modified polymerase, e.g. modified to lower the frequency of branching events, are described herein. The binding pocket is a portion of the polymerase that encompasses the nucleotide binding site and analog base during the pairing of a nucleotide analog with a template DNA. Because of the physical proximity of the binding pocket to the incoming nucleotide or nucleotide analog, mutations to this region can affect the branching fraction. However, mutations that lower the branching fraction are not limited to this area of the polymerase. For example, where amino acid positions are identified relative to a wild-type Φ29 DNA polymerase (e.g., SEQ ID NO:1), these modifications, in addition to those described above, can include any one of, or any combination of: an amino acid substitution at position 153, an amino acid substitution at amino acid position 191, an amino acid substitution at position 388, an amino acid substitution at position 422, an amino acid substitution at position 128; an amino acid substitution at position 253; an amino acid substitution at position 504; an amino acid substitution at position 143; an amino acid substitution at position 183; an amino acid substitution at position 236; an amino acid substitution at position 363; an amino acid substitution at position 215; an amino acid substitution at position 43; an amino acid substitution at position 159; and/or any of the following mutations or combinations thereof: S215D; S43D; T159D; P153L; G191A; T368F; T368P; T368S; T368V; T368N; T368A; T373N; T373V; T373C; I378V; I378F; K379S; K379A; S388A; S388T; K422R; F128M; F128V; I504V; K143D; K512R; Q183S; R236N; L253A; F363Y; L253A, F363Y, and L480M; T368F, K379S, E375Y, and K512Y; T368F and K379S; T368G and K379S; T368F and T373A; E375Y, K512Y and K379S; E375Y, K512Y and T368F; T368F and V514K; T368F and K379T; S388A and P153L; E375Y, K512Y and T368G; T368G and T373A; E375W and T368G; I378K and K379S; T368F and I378K; T368G and I378K; T368G and V514K; E375W and K379T; T373A and K379S; E375W and T373A; E375Y, K512Y and T373A; E375W and I378K; E375Y, K512Y and I378K; T373A and V514K; T373A and I378K; E375Y, K512Y and K379T; I378K and V514K; E375W and V514K; T368G and K379T; and E375Y, K512Y and V514K. A list of specific useful Φ29 mutants and the corresponding reduced branching fraction that they exhibit is provided in Table 5 below. Characteristics of additional useful Φ129 mutants are provided in Table 6. For comparison, wild-type Φ29 polymerase exhibits a branching fraction of about ≥40% for, e.g., an A488dA4P nucleotide analog. Values in the tables were determined as described in Example 1. Additional exemplary mutations and/or mutation combinations that confer reduced branching fraction can be found herein, e.g., in Tables 13 and 16 and FIGS. 34-35.

TABLE 5

| Mutation Name | Branching Fraction (%) |
|---|---|
| N62D_T368F_K379S_E375Y_K512Y | 8.01 |
| N62D_T368F_K379S | 6.47 |
| N62D_T368P | 6.58 |
| N62D_T368G_K379S | 6.96 |
| N62D_T368F_T373A | 6.99 |
| N62D_T368S | 7.32 |
| N62D_E375Y_K512Y_K379S | 7.66 |
| N62D_E375Y_K512Y_T368F | 8.53 |

TABLE 5-continued

| Mutation Name | Branching Fraction (%) |
|---|---|
| N62D_T368F_V514K | 8.58 |
| N62D_T368F_K379T | 8.71 |
| N62D_S388A_P153L | 8.93 |
| N62D_T368V | 9.94 |
| N62D_E375Y_K512Y_T368G | 10.14 |
| N62D_T368D | 10.41 |
| N62D_T368G_T373A | 10.69 |
| N62D_T368N | 10.73 |
| N62D_E375W_T368G | 12.04 |
| N62D_G191A | 12.32 |
| N62D_I378K_K379S | 12.47 |
| N62D_K379A | 12.75 |
| N62D_T368F_I378K | 13.30 |
| N62D_K379S | 13.34 |
| N62D_T368F | 13.55 |
| N62D_T368G_I378K | 13.59 |
| N62D_T368G_V514K | 14.01 |
| N62D_E375W_K379T | 14.66 |
| N62D_T373A_K379S | 14.72 |
| N62D_S388T | 14.82 |
| N62D_E375W_T373A | 16.40 |
| N62D_T368A | 16.60 |
| N62D_I378V | 17.38 |
| N62D_E375Y_K512Y_T373A | 17.54 |
| N62D_T373N | 17.63 |
| N62D_E375W_I378K | 17.70 |
| N62D_E375Y_K512Y_I378K | 17.83 |
| N62D_T373A_V514K | 17.87 |
| N62D_T373A_I378K | 17.89 |
| N62D_T373V | 18.26 |
| N62D_I378F | 18.32 |
| N62D_E375Y_K512Y_K379T | 18.72 |
| N62D_I378K_V514K | 18.74 |
| N62D_T368E | 18.82 |
| N62D_E375W_V514K | 19.68 |
| N62D_T368G_K379T | 19.77 |
| N62D_T373C | 20.54 |
| N62D_K422R | 20.68 |
| N62D_T368G | 21.48 |
| E375Y_K512Y_V514K | 24.90 |
| N62D_F128M | 8.86 |
| N62D_F128V | 8.35 |
| L253A_F363Y_L480M | 9.59 |
| N62D_I504V | 5.24 |
| N62D_K143D | 9.66 |
| N62D_K512R | 8.63 |
| N62D_Q183S | 9.62 |
| N62D_R236N | 9.71 |

TABLE 6

Characterization of modified recombinant Φ29 polymerases including S215D, S43D, and T159D substitutions.

| Mutation | Vmax (RFU/sec) | Km (µM) | kcat (bpm) | specificity (kcat/km) | BF %[a] |
|---|---|---|---|---|---|
| N62D_S215D_T368F_E375Y_K512Y | 15621.43 | 2.62 | 150.62 | 57.41 | 6.41 |
| S43D_N62D_T368F_E375Y_K512Y | 14682.09 | 3.53 | 141.56 | 40.13 | 10.01 |
| N62D_T159D_T368F_E375Y_K512Y | 13408.60 | 2.21 | 129.28 | 58.59 | 9.51 |
| N62D_T368F_E375Y_K512Y | 13343.50 | 2.00 | 128.65 | 64.18 | 11.09 |

[a]BF: branching fraction incorporate. Branching is expressed as a percentage of the dissociation events vs. the total sum events, e.g., dissociation and association events. For example, for an N62D/T368G Φ29 mutant polymerase, for every 100 times an A488dA4P analog interacts with the binding pocket of this polymerase, 21.477 of the events are non-productive dissociation events, e.g., wherein the analog dissociates from the polymerase instead of participating in a polymerization reaction.

The branching fraction represented in Tables 5 and 6 is measured by "loading" a polymerase active site with a cognate-matching nucleotide analog that can bind in the +1 and +2 positions. In the absence of divalent cation this nucleotide cannot be incorporated into the DNA strand, so will pair with the template nucleotide at the +1 position but be released at some frequency specific for that analog/polymerase combination, e.g., the branching rate. This 'loading' reaction is then followed by a 'chase' reaction consisting of a divalent cation that supports extension, e.g., $Mn^{2+}$), and a terminating-type nucleotide analog, e.g., a dideoxynucleotide, comprising the same base as the cognate-matching analog in the loading step.

The dideoxy-analog will be incorporated into any +1 sites that are unoccupied and, once added, preclude further extension. Hence polymerase active sites that are already occupied by a paired analog base extend to the +2 position, while those that are not occupied (i.e. "branched") incorporate the dideoxy-type analog at +1 and do not extend, resulting in a single base addition. The extension products of this reaction are visualized by standard separation methods, e.g., gel or capillary electrophoresis, and the ratio of terminated product that is generated when a dideoxynucleotide is incorporated at the +1 position divided by the total terminated product, e.g., when a dideoxynucleotide is incorporated at both the +1 and +2 positions, indicates the fraction of 'branched' events that occur.

The branching fraction exhibited by a modified polymerase, e.g., a modified Φ129 polymerase, a modified Φ29-type polymerase, or a modified exonuclease-deficient Φ129 polymerase, can be less than a branching fraction exhibited by the parental polymerase for a given nucleotide analog or, e.g., less than 25% for a phosphate-labeled nucleotide analog, less than 20% for the phosphate-labeled analog, less than 15% for the phosphate-labeled analog, or less than 10% for the phosphate-labeled analog.

Figure 3:
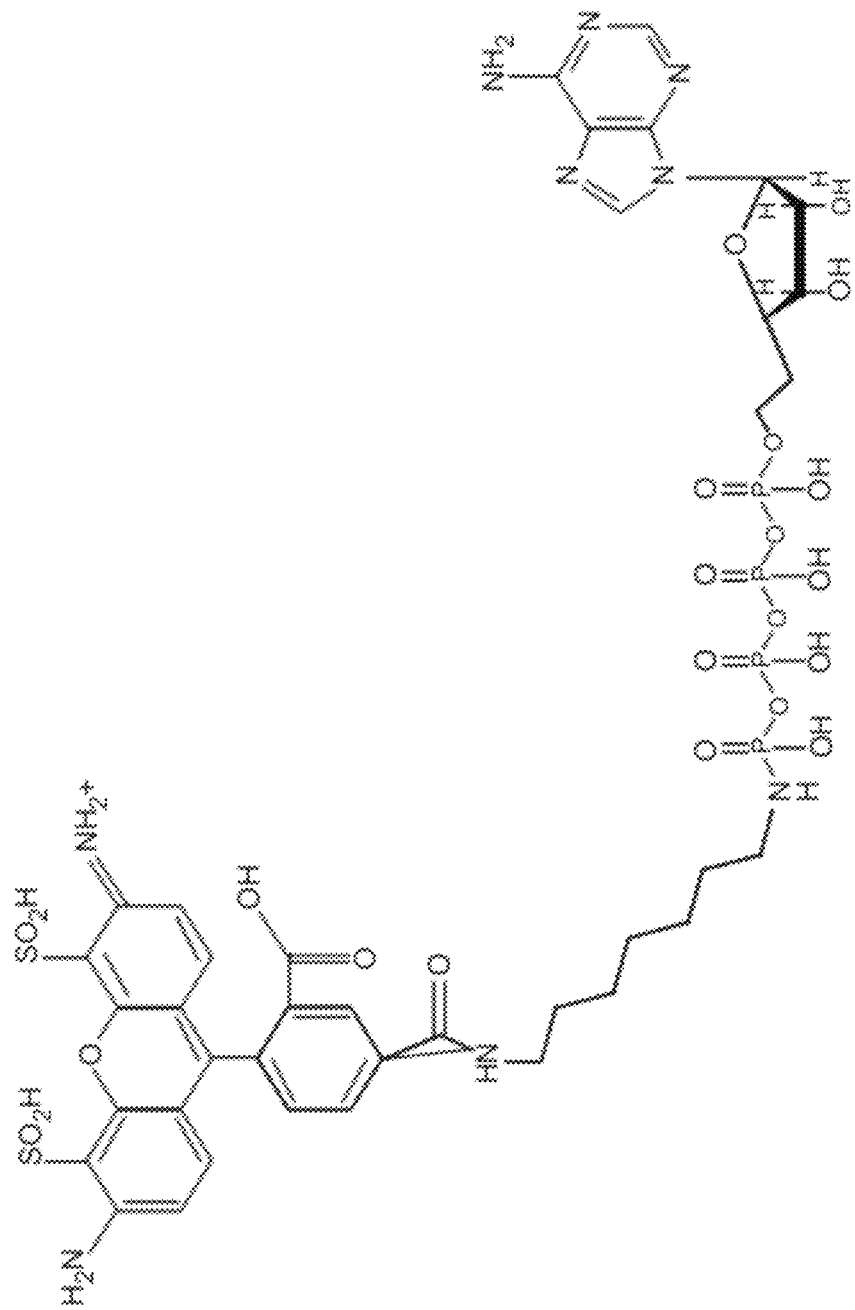
FIG. 3 depicts the structure of A488dA4P.

As noted, the branching fraction, e.g., % branching, is a relative measure of the number of times a correctly paired base, e.g., a Watson-Crick paired base, leaves the active site of the polymerase without forming a phosphodiester bond with the 3' OH of the primer-terminus relative to the total number of interactions that occur between the nucleotide (or nucleotide analog) and the binding pocket of the polymerase, e.g., the total number of opportunities the nucleotide or nucleotide analog, e.g., A488dA4P in FIG. 3, has to correctly pair and incorporate.

In some embodiments, the modified polymerase that exhibits a reduced frequency of branching can also exhibit a $K_m$ for a given phosphate-labeled nucleotide analog, e.g., any of the phosphate-labeled nucleotide analogs described herein, that is less than 10 µM. For enzymes obeying simple Michaelis-Menten kinetics, kinetic parameters are readily derived from rates of catalysis measured at different substrate concentrations. The Michaelis-Menten equation, $V=V_{max}[S]([S]+K_m)^{-1}$ relates the concentration of uncombined substrate ([S], approximated by the total substrate concentration), the maximal rate ($V_{max}$, attained when the enzyme is saturated with substrate), and the Michaelis constant ($K_m$, equal to the substrate concentration at which the reaction rate is half of its maximal value), to the reaction rate (V). To determine a $K_m$ for a particular analog a series of extension reactions are performed with a varying concentration of the analog of interest with a fixed, saturating concentration of native nucleotides. A fit of the rate versus the substrate concentration generates estimation of the $-K_m$ as the slope of this line. Modified polymerases that exhibit reductions in branching fraction can also exhibit increased accuracy of nucleotide incorporation. The modified polymerases optionally exhibit improved specificity, e.g., as assessed by determining $k_{cat}/K_m$.

E. Recombinant Polymerases With Altered Divalent Metal Cofactor Selectivity

The phosphoryl transfer reaction of DNA polymerases is typically catalyzed by a two-metal ion mechanism, where two divalent metal ions, e.g., $Mg^{++}$ and/or $Mn^{++}$, complexed with the DNA polymerase facilitate the incorporation of a nucleotide into the 3'OH of the extension product. One of the metal ions is proposed to interact with the 3'OH of the primer strand, thereby facilitating its attack on the α-phosphate of the incoming nucleotide. Both metal ions are believed to stabilize the transition state that occurs during the course of the extension reaction.

During the course of the polymerase reaction, divalent metal cofactors, such as magnesium or manganese, will interact with the enzyme-substrate complex, playing a role in catalysis as well as a structural role in definition of the active site. For a discussion of metal cofactor interaction in polymerase reactions, see, e.g., Arndt, et al., Biochemistry (2001) 40:5368-5375. For example, and without being bound to any particular theory of operation, it is understood that metal cofactor binding in and around the active site serves to stabilize binding of incoming nucleotides. For further details regarding the effect of metal cofactors on polymerase kinetics and nucleic acid synthesis reactions, see Bjornson et al. PCT Application Serial Number PCT/US2009/002003 "TWO SLOW-STEP POLYMERASE ENZYME SYSTEMS AND METHODS," incorporated herein by reference in its entirety for all purposes.

In the synthesis reaction, certain divalent or trivalent metal cofactors such as magnesium and manganese are known to interact with the polymerase to modulate the progress of the reaction (See, e.g., U.S. Pat. No. 5,409,811). As will be appreciated, depending upon the nature of the polymerization reaction, environmental conditions (e.g., temperature, pH, etc.), the polymerase used, the nucleotides employed, etc., different metal co-factors (and when two or more cofactors are included in the reaction conditions, the ratios of such cofactors) will have widely varying catalytic effects upon the polymerization reaction. For example, under conditions where the ratio of $Mg^{++}$ to $Mn^{++}$ is, e.g., greater than 1, polymerases can exhibit increased branching fractions. Therefore, in applications where branching is deleterious to readout accuracy, it may be necessary to reduce or eliminate $Mg^{++}$ from the reaction conditions. However, the same polymerases that exhibit increased branching in the presence of $Mg^{++}$ can also display undesirable kinetic properties when $Mg^{++}$ is reduced or eliminated from the reaction conditions, e.g., reduced processivity and/or fidelity in the absence of $Mg^{++}$.

In light of the above observations, polymerases that are tolerant to $Mg^{++}$ (e.g., polymerases which do not exhibit increased branching, etc. in single molecule sequencing reactions in the presence of $Mg^{++}$) are desirable. Among other aspects, the present invention provides such polymerases, particularly Φ29-type polymerases. For example, polymerases of the invention optionally comprise one or more mutations to enhance or confer $Mg^{++}$ tolerance (e.g., the reduction or elimination of increased branching in the presence of $Mg^{++}$). Positions (identified relative to wild-type Φ29 DNA polymerase) that are optionally modified to enhance $Mg^{++}$ tolerance preferably include L253. Specific exemplary mutations at this position include L253M, L253G, L253Q, L253I, L253Y, L253D, preferably L253H or L253S, more preferably L253C, and still more preferably L253A. Other positions and substitutions of potential interest include, e.g., K13, V250, K402, I474, K131, V250A, V250F, K402A, I474H, and I474C. Combinations comprising mutations influencing $Mg^{++}$ tolerance include, as just a few examples, L253A and A484E; N62D, L253A, E375Y, A484E and K512Y; L253A, E375Y, A484E and K512Y; N62D, L253A, E375Y and K512Y; and L253A, E375Y and K512Y; see also other combinations listed herein, e.g., in Tables 13 and 16 and FIGS. 34 and 35. Polymerases comprising mutations conferring $Mg^{++}$ tolerance optionally also include one or more additional mutations or combinations of mutations noted herein and/or one or more exogenous features at the N- and/or C-terminal region of the polymerase (e.g., a polyhistidine tag, e.g., a His10 tag, at the N- and/or C-terminal region, a Btag at the N-terminal region, and combinations thereof).

F. Recombinant Polymerases with Increased Thermostability and Yield

As noted, various combinations of the individual mutations described herein can be introduced into recombinant polymerases to confer a variety of advantageous properties on the polymerases. However, introducing additional mutations into a polymerase can have deleterious effects on its thermostability and/or on yield when the polymerase is purified. See, for example, the left-hand portion of FIG. 40, which charts protein yield from a high throughput purification procedure for three recombinant Φ29 polymerases: one with N62D, L253A, E375Y, A484E, and K512Y substitutions, one with L253A, E375Y, A484E, and K512Y substitutions and a C-terminal His10 tag, and one with L253A, E375Y, A484E, D510K, and K512Y substitutions and a C-terminal His10 tag. We have found that protein yield can decrease dramatically with increasing number of mutations in these three polymerases.

Mutations that increase yield are thus desirable. Mutations that increase protein thermostability are also desirable, not only because such mutations often also increase protein yield, but also because increased thermostability can result in longer lifetime of the polymerase, e.g., under assay conditions used in single molecule sequencing.

Mutations at a number of positions can increase protein yield and/or thermostability. Positions of particular interest include, e.g., V250I, E239G, Y224, E515, F526, and E508, where positions are identified relative to wild-type Φ29 polymerase (SEQ ID NO:1). Suitable substitutions at these positions include, for example, V250I, E239G, Y224K, E515K, E515Q, F526L, E508K, and E508R, as well as Y224Q, Y224R, E515H, E515Y, E515N, E515P, E515R, E515S, E515A, F526Q, F526K, F526I, F526T, F526M, and F526V.

As a few examples, we have found that an E239G substitution can increase protein yield approximately twofold in a variety of contexts. A V250I substitution can increase protein yield approximately 1.6 fold. A Y224K substitution can increase protein yield approximately fourfold. An E515K substitution can increase yield approximately eightfold, while an E515Q substitution can increase protein yield approximately twofold and can also increase accuracy by reducing the number of missing bases; however, both substitutions tend to increase pulse widths. An F526L substitution can increase protein yield approximately tenfold, but can also increase pausing. E508K and E508R substitutions also can increase yield approximately 1.2 fold and threefold, respectively.

Figure 40:
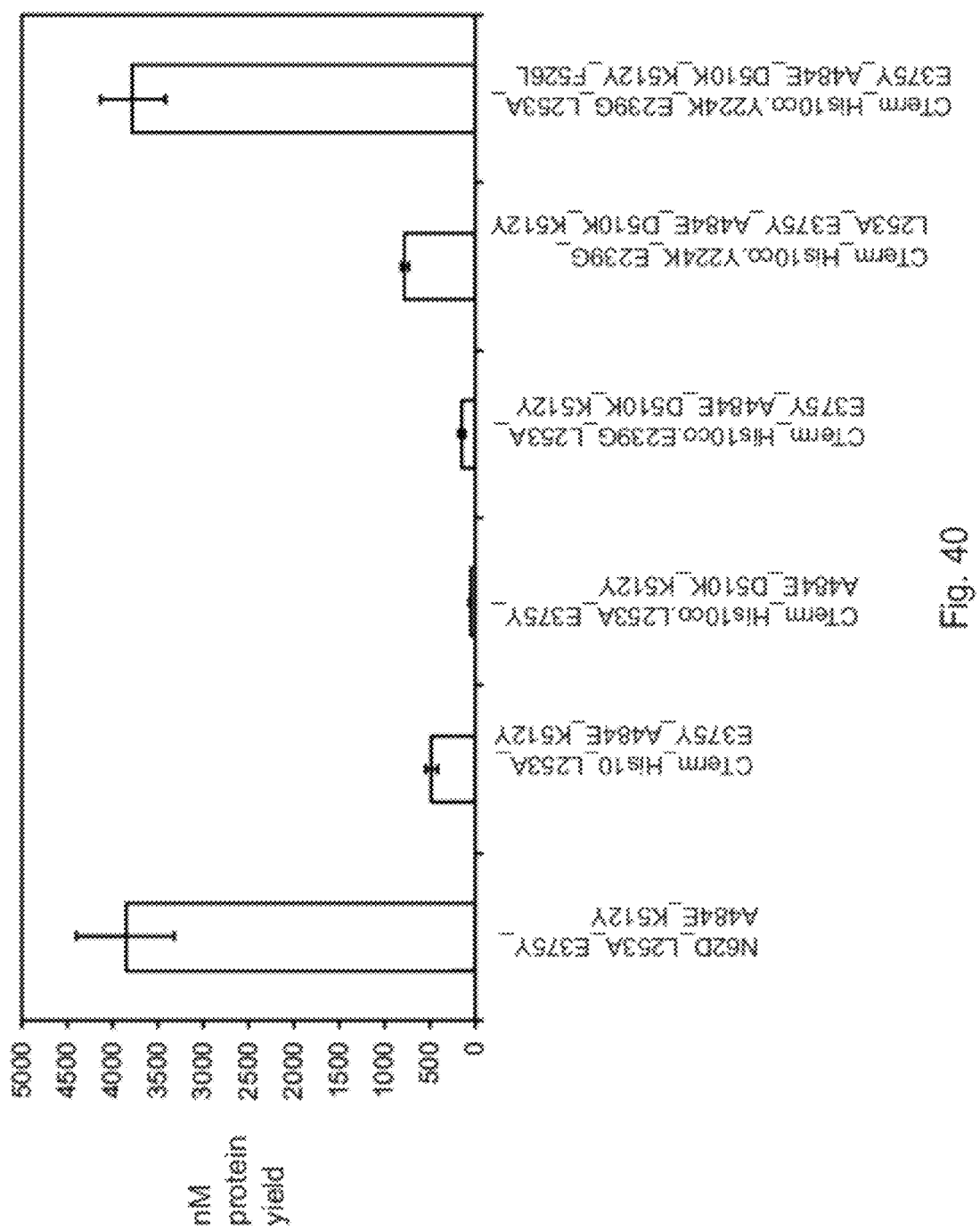
FIG. 40 presents a bar graph comparing yield from a high throughput protein purification procedure applied to comparable numbers of cells expressing six recombinant Φ29 polymerases: one with N62D, L253A, E375Y, A484E, and K512Y substitutions; one with L253A, E375Y, A484E, and K512Y substitutions and a C-terminal His 10 tag; one with L253A, E375Y, A484E, D510K, and K512Y substitutions and a C-terminal His10 tag; one with E239G, L253A, E375Y, A484E, D510K, and K512Y substitutions and a C-terminal His10 tag; one with Y224K, E239G, L253A, E375Y, A484E, D510K, and K512Y substitutions and a C-terminal His10 tag; and one with Y224K, E239G, L253A, E375Y, A484E, D510K, K512Y, and F526L substitutions and a C-terminal His10 tag. (All bear an N-terminal biotinylation site and His10 tag.)

As shown in the right-hand portion of FIG. 40, addition of such mutations to a recombinant polymerase can considerably increase protein yield. Addition of E239G, a combination of E239G and Y224K, and a combination of E239G, Y224K, and F526L to a polymerase comprising L253A, E375Y, A484E, D510K, and K512Y and a C-terminal His10 tag can produce successively greater increases in yield.

Protein thermostability can be assayed by any of a variety of techniques known in the art. For example, polymerase thermostability can be assessed basically as described in Vedadi et al. (2006) Proc Natl Acad Sci 103:15835-15840. Purified polymerase is incubated with the florescent dye SYPRO® orange, which binds more strongly to partially unfolded protein than to folded or unfolded protein. Fluorescence is monitored as the temperature is increased. The unfolding temperature is determined as the temperature of the midpoint between the initial minimum and maximum in florescent intensity. A recombinant polymerase with increased thermostability thus has a higher unfolding temperature, while a polymerase with decreased thermostability has a lower unfolding temperature.

In an otherwise wild-type Φ29 polymerase, an A484E substitution can be destabilizing, resulting in a decrease of greater than one degree in the unfolding temperature. An L253A substitution can be equally destabilizing. A K512Y substitution can be somewhat less destabilizing, and an E375Y substitution can be slightly destabilizing. We have found that a T368F or T368Y substitution, in contrast, can be strongly stabilizing, providing an increase in unfolding temperature of approximately one degree. The combination of E375Y, K512Y, and T368F can produce a polymerase with an unfolding temperature close to wild-type. A Y224K substitution can also be strongly stabilizing, increasing the unfolding temperature by approximately one degree.

Figure 38A:
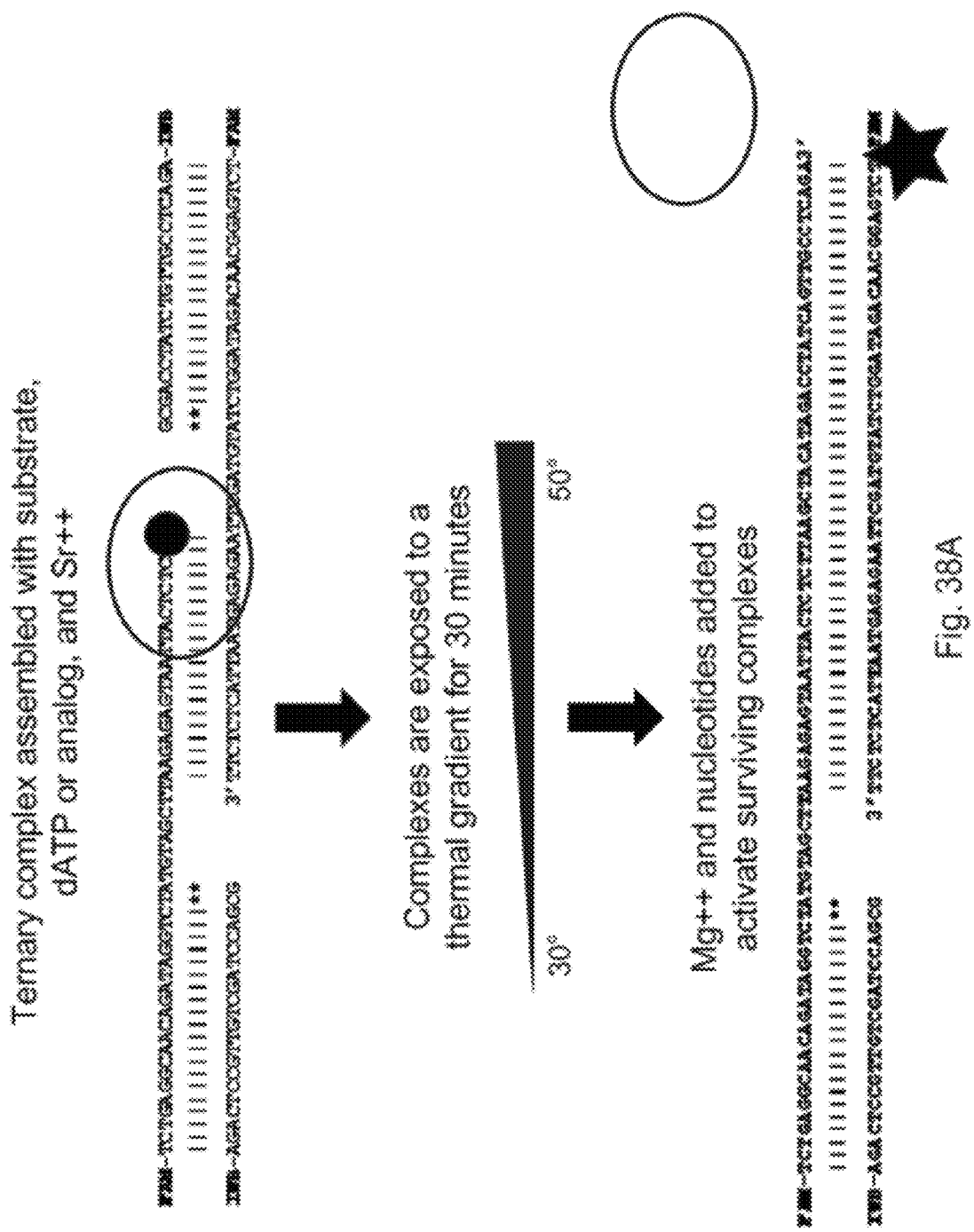
FIG. 38 Panel A schematically illustrates a thermal inactivation assay. The gapped substrate is listed as SEQ ID NOs: 198 and 199 and the extended strand as SEQ ID NO:200. Panel B presents thermal inactivation profiles for five recombinant Φ29 polymerases.

Polymerase thermostability can also be assessed by measuring activity after incubation of the polymerase at different temperatures, optionally in the presence of a substrate and nucleotides or nucleotide analogs. An exemplary thermal inactivation assay is schematically illustrated in FIG. 38 Panel A. A ternary complex including the polymerase, a gapped duplex DNA substrate bearing a fluorophore and a quencher, and a cognate nucleotide triphosphate or analog (e.g., dATP or a hexaphosphate analog thereof) is assembled in the presence of $Sr^{++}$. Samples of the complex are exposed to temperatures between 30° C. and 50° C. for 30 minutes. Nucleotides (the remaining dNTPs) and $Mg^{++}$ are then added; polymerase which has remained active displaces the oligonucleotide bearing the quencher, producing a fluorescent signal.

Thermal inactivation profiles for a series of Φ29 recombinant polymerases are shown in FIG. 38 Panel B. As seen in Panel B, addition of Y224K, E239G, V250I, and E515K substitutions to Φ29 polymerase carrying L253A, E375Y, A484E, and K512Y can increase thermostability. Addition of I467V has only a minor effect, while successive additions of E508R and F526L can further increase thermostability.

Figure 39A:
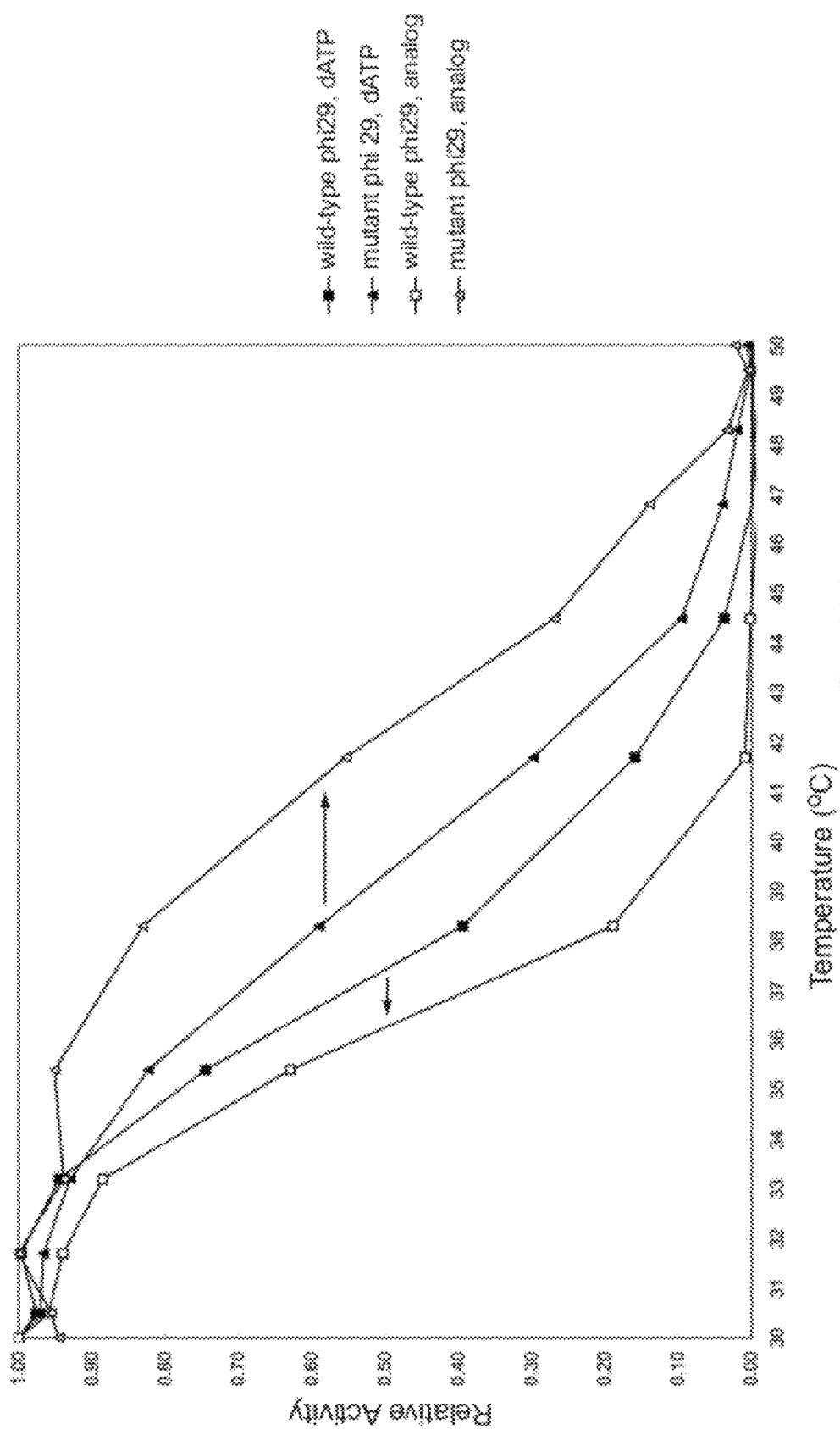
FIG. 39 Panel A presents thermal inactivation profiles for wild-type and L253A, E375Y, A484E, and K512Y recombinant Φ29 polymerases in the presence of dATP or hexaphosphate analog. Panel B presents thermal inactivation profiles for wild-type and L253A, E375Y, A484E, and K512Y recombinant M2Y polymerases in the presence of dATP or hexaphosphate analog.
Figure 39B:
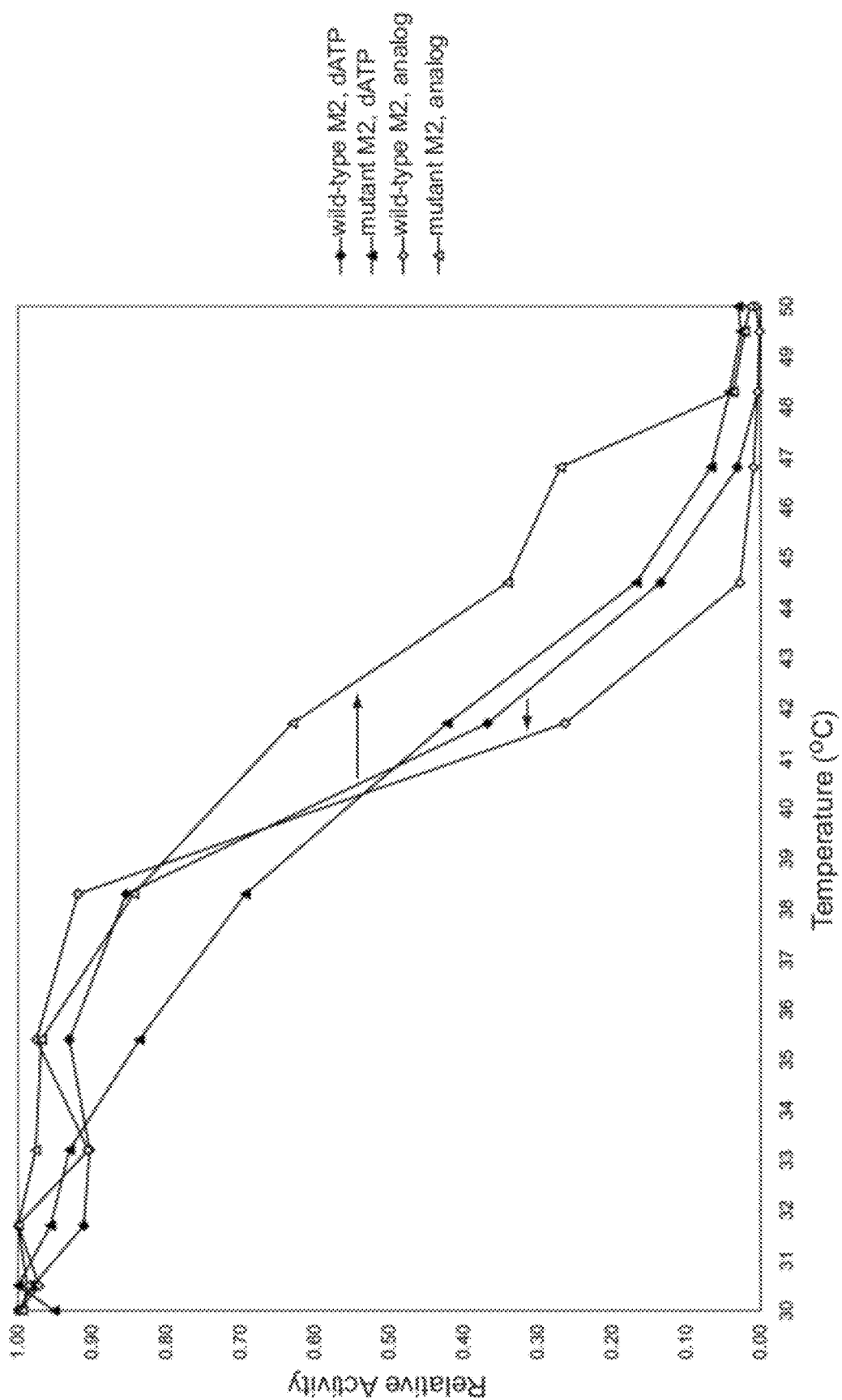

Polymerase thermostability can also be influenced by the identity of other components of the ternary complex, particularly the nucleotides. As shown in FIG. 39 Panel A, wild-type Φ29 polymerase can be less stable when incubated in the presence of a hexaphosphate analog than in the presence of dATP. In contrast, a recombinant Φ29 polymerase bearing L253A, E375Y, A484E, and K512Y can be significantly more stable in the presence of the hexaphosphate analog. Similar results are seen for wild-type M2Y polymerase and recombinant M2Y polymerase with L253A, E375Y, A484E, and K512Y substitutions, as shown in FIG. 39 Panel B. These observations are consistent with the design of the recombinant polymerases; as noted above, the E375Y and K512Y substitutions strengthen interactions with the label on the analog, and the A484E substitution introduces key interactions with the polyphosphate of the analog.

Another approach for enhancing the thermostability of a protein is to introduce mutations into the protein that interact with α-helix dipoles. See, e.g., Nicholson et al. (1988) "Enhanced protein thermostability from designed mutations that interact with α-helix dipoles" Nature 336:651-656. Introduction of mutations near the N-terminus of particular α-helices in polymerases can produce recombinant polymerases that are resistant to high temperatures and/or prolonged exposure to excitation radiation, characteristics useful in applications such as DNA sequencing (e.g., single molecule sequencing), PCR analysis, and the like.

Wild-type Φ29 DNA polymerase has 13 α-helices. Mutating residues near the N-terminus of 10 of these α-helices, where the wild-type residue is mutated to an acidic amino acid (e.g., aspartic acid, glutamic acid, and the like), can result in a Φ29 polymerase with enhanced stability (e.g., thermostability and/or photostability) and improved performance in single molecule sequencing applications. Mutation(s) that result in minimal perturbation of the three-dimensional structure of the polymerase are generally preferred. Positions relative to a wild-type Φ29 DNA polymerase that can be mutated for enhanced stability include, e.g., S43, N62, P129, T159, T189, T203, S215, S252, S329, F360, and T427. Exemplary substitutions include, e.g., S43D, N62D, P129D, T159D, T189D, T203D, S215D, S252D, S329D, F360D, and T427D. Characterization of exemplary Φ29 polymerases including such mutations are provided in Table 7. Resistance to photodamage can be assessed, e.g., as described in U.S. patent application Ser. No. 12/384,110 filed Mar. 30, 2009, by Keith Bjornson et al. entitled "Enzymes Resistant to Photodamage."

TABLE 7

| Mutation | $V_{max}$ (RFU/sec) | Km (uM) | kcat (bpm) | Specificity (kcat/km) | BF % | PR % |
|---|---|---|---|---|---|---|
| S43D_N62D_T368F_E375Y_K512Y | 14682.09 | 3.53 | 141.56 | 40.13 | 10.01 | 0.29 |
| N62D_T159D_T368F_E375Y_K512Y | 13408.60 | 2.21 | 129.28 | 58.59 | 9.51 | 0.24 |
| N62D_S215D_T368F_E375Y_K512Y | 15621.43 | 2.62 | 150.62 | 57.41 | 6.41 | 0.00 |

Design and Characterization of Recombinant Polymerases

In addition to methods of using the polymerases and other compositions herein, the present invention also includes methods of making the polymerases. (Polymerases made by the methods are also a feature of the invention, and it will be evident that, although various design strategies are detailed herein, no limitation of the resulting polymerases to any particular mechanism is thereby intended.) As described, methods of making a recombinant DNA polymerase can include structurally modeling a parental polymerase, e.g., using any available crystal structure and molecular modeling software or system. Based on the modeling, one or more amino acid residue positions in the polymerase are identified as targets for mutation. For example, one or more feature affecting closed complex stability, nucleotide access to or removal from the active site (and, thereby, branching), binding of a DNA or nucleotide analog, product binding, etc. is identified. These residues can be, e.g., in the active site or a binding pocket or in a domain such as the exonuclease, TPR2 or thumb domain (or interface between domains) or proximal to such domains. The DNA polymerase is mutated to include different residues at such positions (e.g., another one of the nineteen other commonly occurring natural amino acids or a non-natural amino acid, e.g., a nonpolar and/or aliphatic residue, a polar uncharged residue, an aromatic residue, a positively charged residue, or a negatively charged residue), and then screened for an activity of interest (e.g., processivity, $k_{off}$, $K_d$, branching fraction, decreased rate constant, balanced rate constants, accuracy, speed, thermostability, yield, cofactor selectivity, etc.). It will be evident that catalytic and/or highly conserved residues are typically (but not necessarily) less preferred targets for mutation.

Further, as noted above, a polymerase of the invention (e.g., a Φ29-type DNA polymerase that includes E375 and K512 mutations and one or more additional mutations or a Φ29-type DNA polymerase that includes L253 and A484 mutations) can be further modified to enhance the properties of the polymerase. For example, a polymerase comprising a combination of the above mutations can be mutated at one or more additional sites to enhance a property already possessed by the polymerase or to confer a new property not provided by the existing mutations. Details correlating polymerase structure with desirable functionalities that can be added to polymerases of the invention are provided herein. Also provide below are various approaches for modifying/mutating polymerases of the invention, determining kinetic parameters or other properties of the modified polymerases (e.g., determining whether a polymerase exhibits a slow step phenotype), screening modified polymerases, and adding exogenous features to the N- and/or C-terminal regions of the polymerases.

Structure-Based Design of Recombinant Polymerases

Structural data for a polymerase can be used to conveniently identify amino acid residues as candidates for mutagenesis to create recombinant polymerases, for example, having modified active site regions and/or modified domain interfaces to reduce reaction rates, reduce branching, improve complex stability, reduce exonuclease activity, alter cofactor selectivity, increase stability, improve yield, or confer other desirable properties. For example, analysis of the three-dimensional structure of a polymerase such as Φ29 can identify residues that are in the active polymerization site of the enzyme, residues that form part of the nucleotide analog binding pocket, and/or amino acids at an interface between domains.

The three-dimensional structures of a large number of DNA polymerases have been determined by x-ray crystallography and nuclear magnetic resonance (NMR) spectroscopy, including the structures of polymerases with bound templates, nucleotides, and/or nucleotide analogs. Many such structures are freely available for download from the Protein Data Bank, at (www(dot)rcsb(dot)org/pdb. Structures, along with domain and homology information, are also freely available for search and download from the National Center for Biotechnology Information's Molecular Modeling DataBase, at www(dot)ncbi(dot)nlm(dot)nih(dot)gov/Structure/MMDB/mmdb(dot)shtml. The structures of Φ29 polymerase, Φ29 polymerase complexed with terminal protein, and Φ29 polymerase complexed with primer-template DNA in the presence and absence of a nucleoside triphosphate are available; see Kamtekar et al. (2004) "Insights into strand displacement and processivity from the crystal structure of the protein-primed DNA polymerase of bacteriophage Φ29" Mol. Cell. 16(4): 609-618), see Kamtekar et al. (2006) "The phi29 DNA polymerase:protein-primer structure suggests a model for the initiation to elongation transition" EMBO J. 25(6):1335-43, and Berman et al. (2007) "Structures of phi29 DNA polymerase complexed with substrate: The mechanism of translocation in B-family polymerases" EMBO J. 26:3494-3505, respectively. The structures of additional polymerases or complexes can be modeled, for example, based on homology of the polymerases with polymerases whose structures have already been determined. Alternatively, the structure of a given polymerase (e.g., a wild-type or modified polymerase), optionally complexed with a DNA (e.g., template and/or primer) and/or nucleotide analog, or the like, can be determined.

Techniques for crystal structure determination are well known. See, for example, McPherson (1999) *Crystallization of Biological Macromolecules* Cold Spring Harbor Laboratory; Bergfors (1999) *Protein Crystallization* International University Line; Mullin (1993) *Crystallization* Butterwoth-Heinemann; Stout and Jensen (1989) *X-ray structure determination: a practical guide, 2nd Edition* Wiley Publishers, New York; Ladd and Palmer (1993) *Structure determination by X-ray crystallography, 3rd Edition* Plenum Press, New York; Blundell and Johnson (1976) *Protein Crystallography* Academic Press, New York; Glusker and Trueblood (1985) *Crystal structure analysis: A primer, 2nd Ed.* Oxford University Press, New York; *International Tables for Crystallography, Vol. F. Crystallography of Biological Macromolecules*; McPherson (2002) *Introduction to Macromolecular Crystallography* Wiley-Liss; McRee and David (1999) *Practical Protein Crystallography, Second Edition* Academic Press; Drenth (1999) *Principles of Protein X-Ray Crystallography* (Springer Advanced Texts in Chemistry) Springer-Verlag; Fanchon and Hendrickson (1991) Chapter 15 of *Crystallographic Computing, Volume 5* IUCr/Oxford University Press; Murthy (1996) Chapter 5 of *Crystallographic Methods and Protocols* Humana Press; Dauter et al. (2000) "Novel approach to phasing proteins: derivatization by short cryosoaking with halides" Acta Cryst. D56:232-237; Dauter (2002) "New approaches to high-throughput phasing" Curr. Opin. Structural Biol. 12:674-678; Chen et al. (1991) "Crystal structure of a bovine neurophysin-II dipeptide complex at 2.8 Å determined from the single-wavelength anomalous scattering signal of an incorporated iodine atom" Proc. Natl. Acad. Sci. USA, 88:4240-4244; and Gavira et al. (2002) "Ab initio crystallographic structure determination of insulin from protein to electron density without crystal handling" Acta Cryst. D58:1147-1154.

In addition, a variety of programs to facilitate data collection, phase determination, model building and refinement, and the like are publicly available. Examples include, but are not limited to, the HKL2000 package (Otwinowski and Minor (1997) "Processing of X-ray Diffraction Data Collected in Oscillation Mode" Methods in Enzymology 276: 307-326), the CCP4 package (Collaborative Computational Project (1994) "The CCP4 suite: programs for protein crystallography" Acta Crystallogr D 50:760-763), SOLVE and RESOLVE (Terwilliger and Berendzen (1999) Acta Crystallogr D 55 (Pt 4): 849-861), SHELXS and SHELXD (Schneider and Sheldrick (2002) "Substructure solution with SHELXD" Acta Crystallogr D Biol Crystallogr 58:1772-1779), Refmac5 (Murshudov et al. (1997) "Refinement of Macromolecular Structures by the Maximum-Likelihood Method" Acta Crystallogr D 53:240-255), PRODRG (van Aalten et al. (1996) "PRODRG, a program for generating molecular topologies and unique molecular descriptors from coordinates of small molecules" J Comput Aided Mol Des 10:255-262), and O (Jones et al. (1991) "Improved methods for building protein models in electron density maps and the location of errors in these models" Acta Crystallogr A 47 (Pt 2): 110-119).

Techniques for structure determination by NMR spectroscopy are similarly well described in the literature. See, e.g., Cavanagh et al. (1995) *Protein NMR Spectroscopy: Principles and Practice*, Academic Press; Levitt (2001) *Spin Dynamics: Basics of Nuclear Magnetic Resonance*, John Wiley & Sons; Evans (1995) *Biomolecular NMR Spectroscopy*, Oxford University Press; Wüthrich (1986) *NMR of Proteins and Nucleic Acids* (Baker Lecture Series), Kurt Wiley-Interscience; Neuhaus and Williamson (2000) *The Nuclear Overhauser Effect in Structural and Conformational Analysis*, 2nd Edition, Wiley-VCH; Macomber (1998) *A Complete Introduction to Modern NMR Spectroscopy*, Wiley-Interscience; Downing (2004) *Protein NMR Techniques* (Methods in Molecular Biology), 2nd edition, Humana Press; Clore and Gronenborn (1994) *NMR of Proteins* (Topics in Molecular and Structural Biology), CRC Press; Reid (1997) *Protein NMR Techniques*, Humana Press; Krishna and Berliner (2003) *Protein NMR for the Millenium* (Biological Magnetic Resonance), Kluwer Academic Publishers; Kiihne and De Groot (2001) *Perspectives on Solid State NMR in Biology* (Focus on Structural Biology, 1), Kluwer Academic Publishers; Jones et al. (1993) *Spectroscopic Methods and Analyses: NMR, Mass Spectrometry, and Related Techniques* (Methods in Molecular Biology, Vol. 17), Humana Press; Goto and Kay (2000) Curr. Opin. Struct. Biol. 10:585; Gardner (1998) Annu. Rev. Biophys. Biomol. Struct. 27:357; Wüthrich (2003) Angew. Chem. Int. Ed. 42:3340; Bax (1994) Curr. Opin. Struct. Biol. 4:738; Pervushin et al. (1997) Proc. Natl. Acad. Sci. U.S.A. 94:12366; Fiaux et al. (2002) Nature 418: 207; Fernandez and Wider (2003) Curr. Opin. Struct. Biol. 13:570; Ellman et al. (1992) J. Am. Chem. Soc. 114:7959; Wider (2000) BioTechniques 29:1278-1294; Pellecchia et al. (2002) Nature Rev. Drug Discov. (2002) 1:211-219; Arora and Tamm (2001) Curr. Opin. Struct. Biol. 11:540-547; Flaux et al. (2002) Nature 418:207-211; Pellecchia et al. (2001) J. Am. Chem. Soc. 123:4633-4634; and Pervushin et al. (1997) Proc. Natl. Acad. Sci. USA 94:12366-12371.

The structure of a polymerase, or polymerase bound to a DNA or with a given nucleotide analog incorporated into the active site can, as noted, be directly determined, e.g., by x-ray crystallography or NMR spectroscopy, or the structure can be modeled based on the structure of the polymerase and/or a structure of a polymerase with a natural nucleotide bound. The active site or other relevant domain of the polymerase can be identified, for example, by homology with other polymerases, examination of polymerase-template or polymerase-nucleotide co-complexes, biochemical analysis of mutant polymerases, and/or the like. The position of a nucleotide analog (as opposed to an available nucleotide structure) in the active site can be modeled, for example, by projecting the location of non-natural features of the analog (e.g., additional phosphate or phosphonate groups in the phosphorus containing chain linked to the nucleotide, e.g., tetra, penta or hexa phosphate groups, detectable labeling groups, e.g., fluorescent dyes, or the like) based on the previously determined location of another nucleotide or nucleotide analog in the active site.

Such modeling of the nucleotide analog or template (or both) in the active site can involve simple visual inspection of a model of the polymerase, for example, using molecular graphics software such as the PyMOL viewer (open source, freely available on the World Wide Web at www(dot)pymol (dot)org), Insight II, or Discovery Studio 2.1 (commercially available from Accelrys at (www(dot)accelrys(dot)com/products/discovery-studio). Alternatively, modeling of the active site complex of the polymerase or a putative mutant polymerase, for example, can involve computer-assisted docking, molecular dynamics, free energy minimization, and/or like calculations. Such modeling techniques have been well described in the literature; see, e.g., Babine and Abdel-Meguid (eds.) (2004)*Protein Crystallography in Drug Design*, Wiley-VCH, Weinheim; Lyne (2002) "Structure-based virtual screening: An overview" Drug Discov. Today 7:1047-1055; Molecular Modeling for Beginners, at (www (dot)usm(dot)maine(dot)edu/~rhodes/SPVTut/index (dot) html; and Methods for Protein Simulations and Drug Design at (www(dot)dddc(dot)ac(dot)cn/embo04; and references therein. Software to facilitate such modeling is widely available, for example, the CHARMm simulation package, available academically from Harvard University or commercially from Accelrys (at www(dot)accelrys(dot) com), the Discover simulation package (included in Insight II, supra), and Dynama (available at (www(dot)cs(dot)gsu(dot) edu/~cscrwh/progs/progs(dot)html). See also an extensive list of modeling software at (www(dot)netsci(dot)org/Resources/Software/Modeling/MMMD/top(dot)html.

Visual inspection and/or computational analysis of a polymerase model, including optional comparison of models of the polymerase in different states, can identify relevant features of the polymerase, including, for example, residues that can be mutated to stabilize the closed complex of the polymerase, decrease branching, alter rate constants, alter cofactor selectivity, increase thermostability, increase speed, and the like. Such residues can include, for example, amino acid residues of domains that are in close proximity to one another (to stabilize inter-domain interactions), residues in an active site or binding pocket that interact with a nucleotide or analog, DNA, or product, residues that modulate how large a binding pocket for an analog is relative to the analog, etc.

As noted above, inspection of a closed Φ29-DNA complex reveals an important interface formed by the exonuclease, TPR2 and thumb domains, e.g., positions 68 to 76 and position 92 (exonuclease), positions 405 to 413 (TPR2), and positions 560 to 564 (thumb) (all numbered relative to wild-type Φ29). Mutations that stabilize this interface can increase stability of the closed complex and thus increase processivity. The parental polymerase can be mutated to introduce an interaction predicted to stabilize the closed complex. For example, one more residues that are in close proximity to each other in the closed complex can be replaced with residues having complementary features, for example, oppositely charged residues (e.g., aspartic or glutamic acid, and lysine, arginine, or histidine), residues that can hydrogen bond with each other (e.g., serine, threonine, histidine, asparagine, or glutamine), hydrophobic residues that can interact with each other, aromatic residues that can engage in π-π or edge-face stacking interactions, residues that can engage in cation-π interactions, or the like. As noted, a residue can be replaced with another naturally occurring amino acid (e.g., a nonpolar and/or aliphatic residue, a polar uncharged residue, an aromatic residue, a positively charged residue, or a negatively charged residue) or with a non-natural amino acid (e.g., having a chemical group that would interact with group(s) in the polymerase). Similarly, the parental polymerase can be mutated to remove an interaction predicted to destabilize the closed complex (two positively charged or two negatively charged residues in close proximity, residues with unfavorable van der Waals interactions, etc.). Exemplary mutations and/or mutation combinations that confer increased closed complex stability have been described above and can be found, e.g., in Table 13, FIGS. 34-35, and elsewhere herein.

In another example, polymerases can be modified to alter the branching fraction. In a preferred aspect, the modification results in a lower branching fraction relative to the parental polymerase. However, in certain single molecule sequencing approaches (e.g., where redundant signal events are utilized to determine the presence or absence of nucleotide incorporation events), it may be desirable to increase the branching fraction of polymerases of the invention. Details regarding polymerases with increased branching fractions (and uses thereof) can be found in International Publication No. WO 2010/027484 by Pranav Patel, et al. entitled "ENGINEERING POLYMERASES AND REACTION CONDITIONS FOR MODIFIED INCORPORATION PROPERTIES," filed Sep. 4, 2009, the full disclosure of which is incorporated herein by reference in its entirety for all purposes.

The branching fraction for a nucleotide or nucleotide analog can be decreased, for example, by more tightly structuring the binding pocket for the nucleotide or analog. Residues limiting access of the nucleotide or analog to the binding pocket can be altered to decrease steric inhibition, or residues can be modified to introduce favorable interactions with complementary features of the analog.

The size or composition (e.g., position of charged or hydrophobic residues) of the binding pocket in the active site can control entry and release of the nucleotide or analog, which can affect branching fraction. A residue can, for example, be deleted or replaced with a residue having a different (smaller, larger, ionic, non-ionic, etc.) side chain. Similarly, residues that can be altered to introduce desirable interactions with the nucleotide analog can be identified to reduce branching. Such a residue can be replaced with a residue that is complementary with, e.g., a non-natural feature of the analog, for example, with a residue that can hydrogen bond to the analog (e.g., serine, threonine, histidine, asparagine, or glutamine), a hydrophobic residue that can interact with a hydrophobic group on the analog, an aromatic residue that can provide favorable hydrophobic interactions with a group on the analog (e.g., a fluorophore), an aromatic residue that can engage in a $\pi$-$\pi$ or edge-face stacking interaction with an aromatic group in the analog (e.g., a base or fluorophore), a residue that can engage in a cation-$\pi$ interaction with the analog, or a charged residue (e.g., aspartic or glutamic acid, or lysine, arginine, or histidine) that can electrostatically interact with an oppositely charged moiety on the analog (e.g., an additional phosphate group). Interactions with other non-natural features of analogs (e.g., a linker, e.g., between the terminal phosphate and a dye) can also be introduced. As noted, a residue can be replaced with another naturally occurring amino acid (e.g., a nonpolar and/or aliphatic residue, a polar uncharged residue, an aromatic residue, a positively charged residue, or a negatively charged residue) or with a non-natural amino acid (e.g., having a chemical group that would interact with group(s) in the analog). As just one specific example of such structure-based design of polymerases with decreased branching fraction, inspection of a model of the Φ29 polymerase reveals that a modified recombinant polymerase comprising E375Y and K512Y substitutions can exhibit an improved branching fraction phenotype. The amino acid residues 375 and 512 are located in positions predicted to bracket the exit position of the nucleotide analogs, and the aromatic rings of the tyrosines in the aforementioned modified recombinant polymerase can interact favorably with the aromatic groups of the analogs. Exemplary substitutions, deletions, insertions, and combinations thereof, that exhibit reduced branching fraction are found herein, e.g., in Tables 5, 6, 13 and 14 and FIGS. 34-35.

As another example, the parental polymerase can be mutated to decrease at least one elemental reaction rate, to produce a modified polymerase having a rate constant less than that of the parental polymerase. Several exemplary strategies follow.

Figure 4:
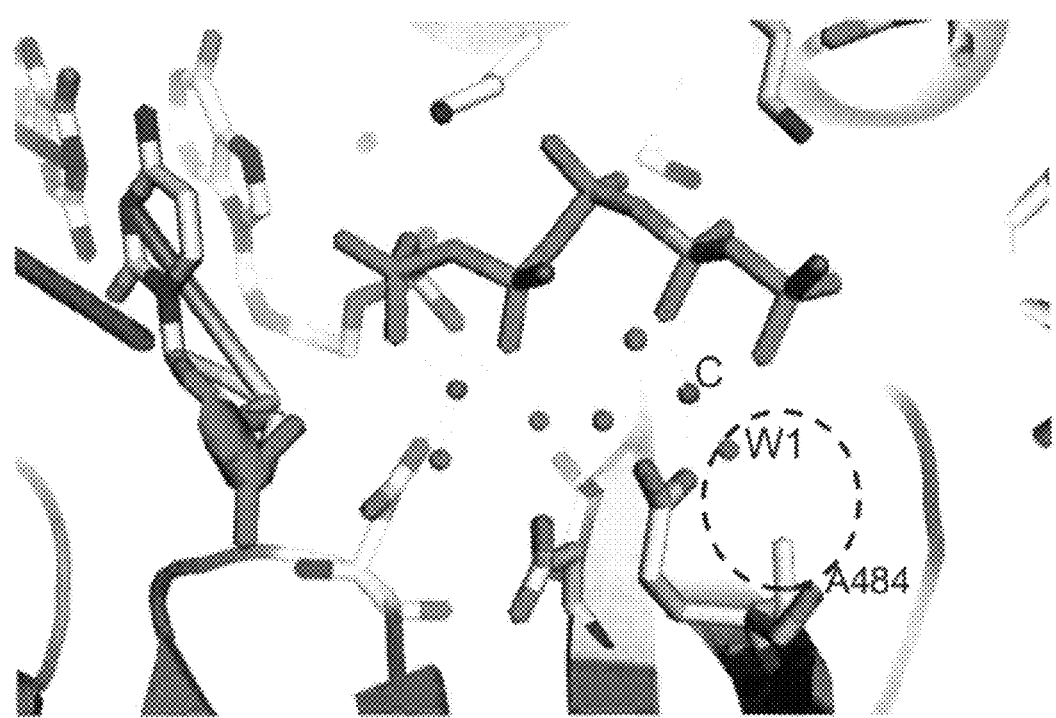
FIG. 4 illustrates a novel metal binding site observed in a crystal structure of D12A/D66A/T368F/E375Y/K512Y Φ29 polymerase complexed with hexaphosphate analog A555dG6P. The novel metal is labeled C.

Examination of a crystal structure of a D12A/D66A/T368F/E375Y/K512Y Φ29 polymerase complexed with analog A555dG6P revealed a new metal binding site (position C in FIG. 4) that is formed by the fifth (epsilon) and sixth (digamma) phosphates of the analog, residue Glu486 and other negatively charged residues in the palm domain, and three fixed water molecules. Metal (e.g., $Mn^{2+}$) binding to the enzyme and analog can be strengthened by replacing the water molecules by either manipulation of the analog phosphate backbone or the polymerase side chains, e.g., by mutation of nearby residues A484 and/or D249, e.g., by site-saturated mutagenesis. Mutations that replace A484 and/or D249 with a larger side chain are of particular interest, such that the mutated residue(s) can replace one or more water molecules and chelate the metal ion with the fifth and sixth phosphates, slowing release of cleaved products. Exemplary mutations include A484E, A484Y, A484H, A484D, D249E, D249Y, D249H, and combinations thereof (e.g., D249E with one of the mutations at position 484).

Figure 20:
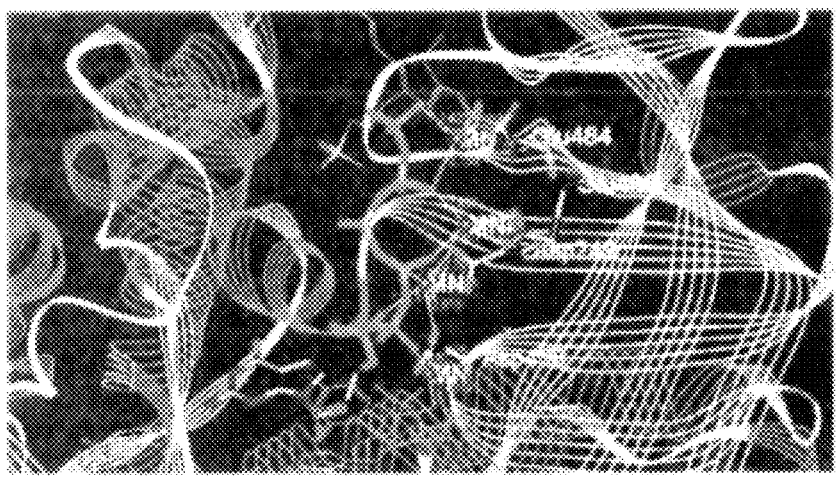
FIG. 20 depicts a computer model showing a possible four metal ion coordination network in a polymerase comprising a A484E substitution.
Figure 21:
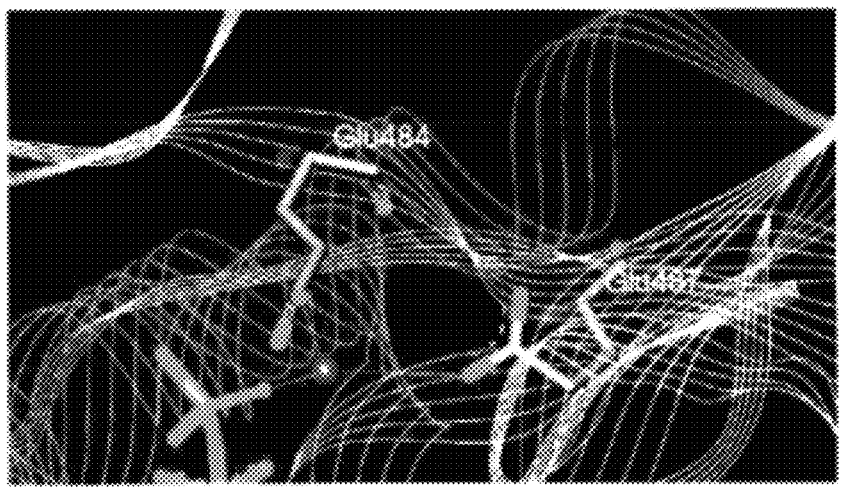
FIG. 21 illustrates how S487E and A484E mutations can strengthen metal ion coordination.

Comparison of two crystal structures of an A484E Φ29 mutant polymerase with increased phosphate binding affinity revealed that the additional metal ion can occupy two different positions (C and D). Computer modeling indicates that a four metal ion coordination network, in which both positions C and D are occupied by a metal ion, can be designed to stabilize binding of analogs with six or more phosphates (FIG. 20). Mutation of Ala484 to Glu helps free E486, which originally bound metal C, to bind the additional metal ion D. An S487E or S487D mutation can also enhance coordination of the additional metal ion. A modified polymerase including A484E and S487E mutations (in a E375Y/K512Y/T368F background) exhibits a lower branching fraction and enhanced analog binding, and also shows slower release of polyphosphate product as indicated by a Cbz pyrophosphate inhibition assay (e.g., as described hereinbelow). Similarly, an S459D or S459E mutation, for example, in combination with A484E, can assist in coordination of the fourth metal ion (e.g., $Mn^{2+}$). A V247E mutation is optionally also included to increase the negative charge characteristics of the metal binding site's environment, although this residue does not directly assist in coordinating metal.

Figure 26A:
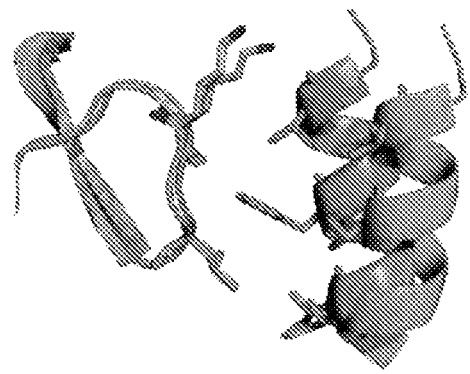
FIG. 26 Panels A and B depict structural changes between the open (includes T368) and closed (includes T368F) conformations of Φ29 polymerase. Panel C depicts Φ29 polymerase.
Figure 26B:
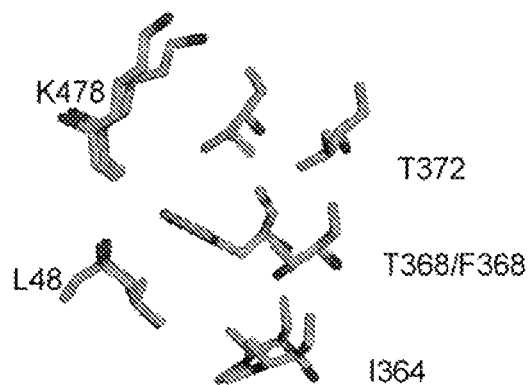
Figure 26C:
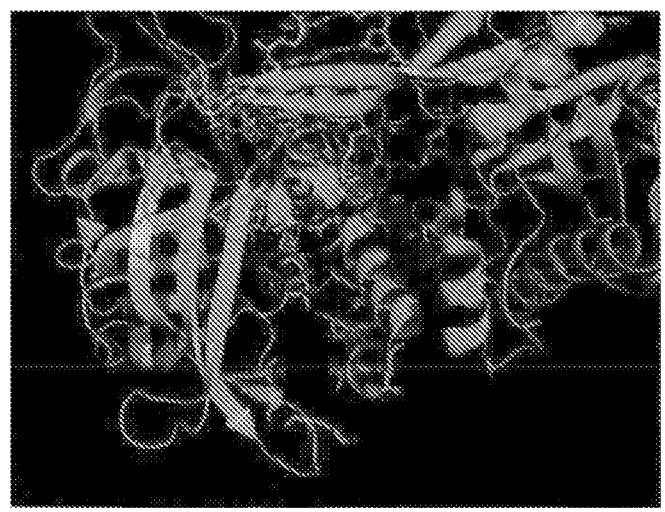

Another strategy for slowing reaction rates involves stabilizing a closed conformation of a ternary complex comprising the polymerase, a DNA, and a nucleotide or nucleotide analog, for example, to slow product release and release of the analog and decrease branching fraction. The parental polymerase can be mutated at one or more positions to introduce at least one intramolecular interaction predicted to stabilize the closed conformation of the ternary complex or to remove at least one intramolecular interaction predicted to destabilize the closed conformation. For example, one or more residues that are in close proximity to each other in the closed conformation of the ternary complex can be replaced with residues having complementary features, for example, oppositely charged residues (e.g., aspartic or glutamic acid, and lysine, arginine, or histidine), residues that can hydrogen bond with each other (e.g., serine, threonine, histidine, asparagine, or glutamine), hydrophobic residues that can interact with each other, aromatic residues that can engage in π-π or edge-face stacking interactions, residues that can engage in cation-π interactions, or the like, e.g., to stabilize the closed conformation of the fingers, the finger-exonuclease domain interface, finger-palm interactions, etc., including natural and non-natural residues as noted herein. Residues identified as targets for stabilizing the closed conformation include, e.g., 179, 198, 211, 255, 259, 360, 363, 365, 370, 372, 378, 381, 383, 387, 389, 393, 433, 478, and 480. Exemplary substitutions include 179Y, 179H, 179A, 179W, 198W, 198A, 198H, 211W, 211A, 211H, 255W, 255A, 255H, 259W, 259A, 259H, 360W, 360A, 360H, 363W, 363A, 363H, 365N, 365Q, 370W, domain and K478 in the palm domain, for example, can assist in maintaining the closed conformation. A view of Φ29 centered on residue T372 is shown in FIG. 26 Panel C. FIG. 26 Panels A and B compare the open and closed conformation of regions around T372. Mutant polymerases including T372Q, T372L, or T372Y/K478Y substitutions show promising results in transient kinetic assays (Table 8).

Figure 27:
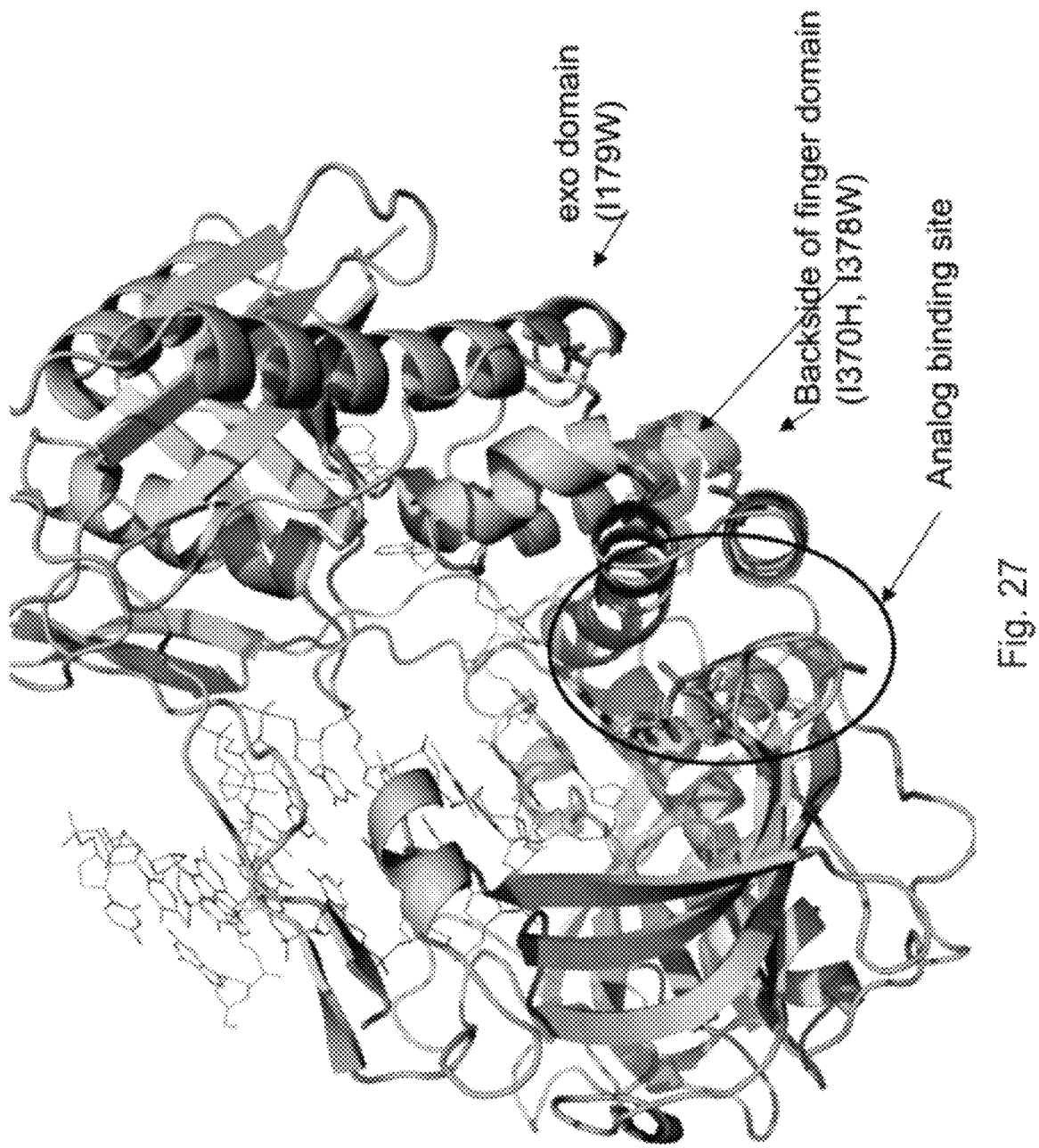
FIG. 27 depicts the location of mutations in the finger and exonuclease domains that stabilize the closed conformation.

As another example, bulky amino acids can be placed in the finger domain on the back side of the binding pocket or in the exonuclease domain to keep the finger and exonuclease domains apart, stabilizing the closed conformation (FIG. 27). Examples include I378W and I370H (finger domain) and I179W (exonuclease domain). Modified polymerases including these substitutions have a lower branching fraction than does the parental enzyme (where the parental enzyme is N62D/E375Y/K512Y/T368F); see Table 8. Residues 179 and 378 can be varied simultaneously, e.g., via combinatorial mutagenesis. As noted elsewhere herein, promising mutations at various positions can be combined.

TABLE 8

Characterization of modified polymerases.

| Mutations | Vmax (RFU/sec) | Km (μM) | kcat (bpm) | BF %[a] |
|---|---|---|---|---|
| N62D_T368F_T372Q_E375Y_K512Y | 16017.80 | 2.19 | 154.44 | 6.63 |
| N62D_T368F_T372L_E375Y_K512Y | 17835.08 | 2.66 | 171.96 | 8.04 |
| N62D_T368F_T372Y_E375Y_K478Y_K512Y | 12347.13 | 3.14 | 119.05 | 7.70 |
| N62D_T368F_T372L_E375Y_K478Y_K512Y | 12423.08 | 2.79 | 119.78 | 8.12 |
| N62D_L253A_T368F_E375Y_K512Y | 14874.50 | 2.23 | 143.42 | 9.79 |
| N62D_I179W_T368F_E375Y_K512Y | 5269.00 | 0.62 | 50.80 | 9.05 |
| N62D_T368F_I370H_E375Y_K512Y | 14312.11 | 1.71 | 137.99 | 7.84 |
| N62D_T368F_E375Y_I378W_K512Y | 12976.19 | 1.96 | 125.11 | 6.50 |

[a]BF: branching fraction 370A, 370H, 372Q, 372L, 372Y, 372H, 372V, 372I, 372F, 372N, 378A, 378H, 378W, 378Y, 381A, 381H, 381W, 383N, 383A, 383L, 383H, 383R, 387L, 387F, 387V, 389A, 389W, 389H, 393A, 393W, 393H, 433A, 433W, 433H, 478Y, 478L, 480H, and 480F, as well as combinations thereof such as T372L/K478Y, T372Y/K478Y, T372Y/K478L, I179A/L381A, I179A/I378A/L381A, I370A/I378A, I179A/I370A/I378A/L381A, I179H/I378H, I179W/I378W, and I179Y/I378Y. Additional exemplary substitutions, deletions, insertions, and combinations thereof, are found in Table 13 and FIG. 34-35. As for the other embodiments herein, site-saturated mutagenesis to all possible residues can also be performed.

For example, the closed conformation can be stabilized by altering interactions between the finger and palm domains. Comparison between a previous crystal structure of a Φ29 DNA polymerase-DNA complex (Berman et al. (2007) EMBO J. 26:3494-3505) and a crystal structure of a D12A/D66A/E375Y/K512Y/T368F Φ29 polymerase in complex with DNA and the analog A555-O-dG6P determined in-house demonstrates that the finger domains move toward the binding pocket when the polymerase binds an incoming nucleotide and changes from the open to the closed conformation. In the open conformation, the finger domains show close contacts with the exonuclease domain. In contrast, in the closed conformation, the finger domain moves toward the binding pocket and makes more contacts with the palm domain. The crystal structure of the modified polymerase shows that the T368F substitution (finger domain) increases hydrophobic interaction with L480 (palm domain), helping stabilize the closed conformation. Increasing hydrophobic interactions or adding a salt bridge between T372 in the finger Increasing interaction between the polymerase and the base of an incoming nucleotide or nucleotide analog can also slow a reaction step, e.g., translocation. Residue 387 can be mutated to a hydrophobic or aromatic residue to increase hydrophobic interactions with the base and/or stack with it. Exemplary mutations include N387L, N387F, and N387V. Site-saturated mutagenesis to all possible residues can also be performed.

Similarly, the polymerase can be mutated to increase interaction between the polymerase and a label on a nucleotide analog, e.g., a terminal fluorophore. As for the embodiments above, one or more residues can be mutated to introduce a favorable interaction between the polymerase and the label or to remove an unfavorable interaction. As one example, residue 514 can be mutated to another hydrophobic residue or to an aromatic residue to improve interaction with a terminal fluorophore, particularly on a hexaphosphate analog. Exemplary mutations include V514Y and V514F.

As another example, the flexibility of either or both of two surface loops on the polymerase, residues 372-397 and 507-514, can be increased by insertion of one or more amino acid residues (e.g., 1-7 residues, e.g., glycine) within either or both loops to facilitate interaction of other regions with the analog (e.g., of residue 512 with a terminal fluorophore, in a mutant polymerase that also includes K512Y). For example, a glycine residue can be introduced after residue 374, 375, 511, and/or 512 (designated as 374.1G, 375.1G, etc.).

Figure 9A:
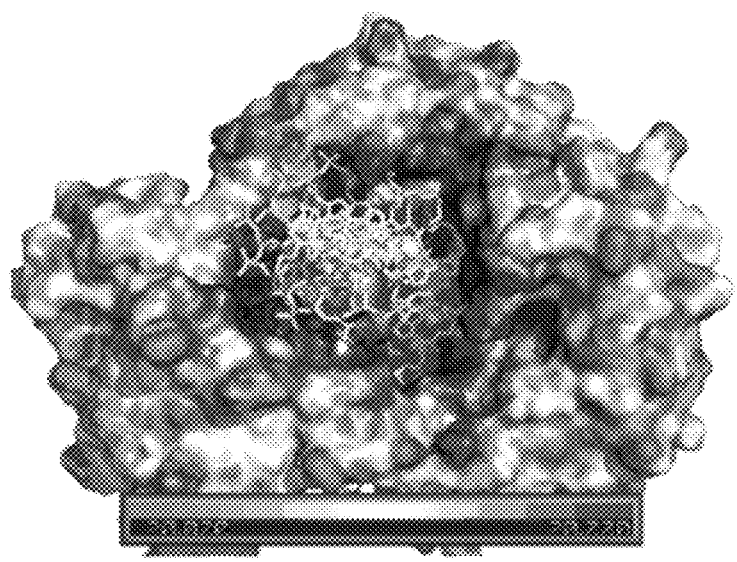
FIG. 9 Panels A and B depict the electrostatic surface of Φ29 polymerase in contact with the DNA. Positive charge is dark gray and negative charge is light gray; the intensity of the color represents the strength of the charge. The wild type of group one residues and the lysine mutants of group one residues are colored in the same scale in Panels A and B, respectively. The DNA binding interface is mainly positively charged. The positive charge on the DNA binding interface is significantly increased after the mutation of group one residues to lysine.
Figure 9B:
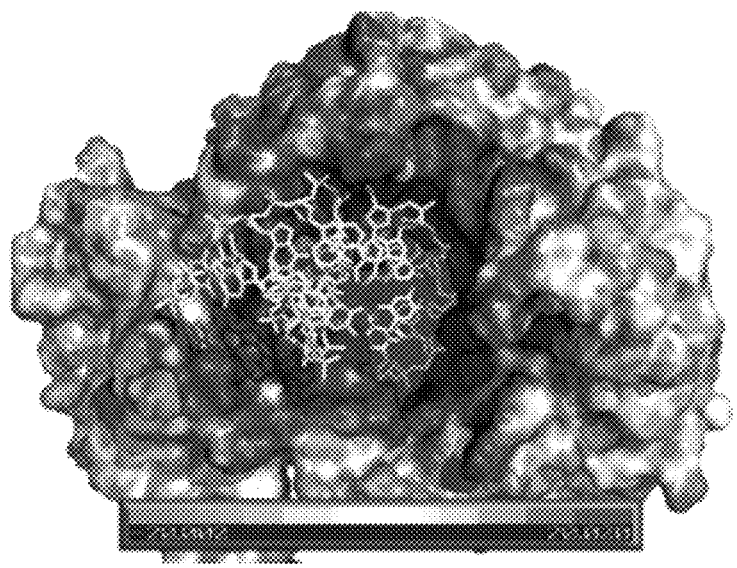
Figure 10A:
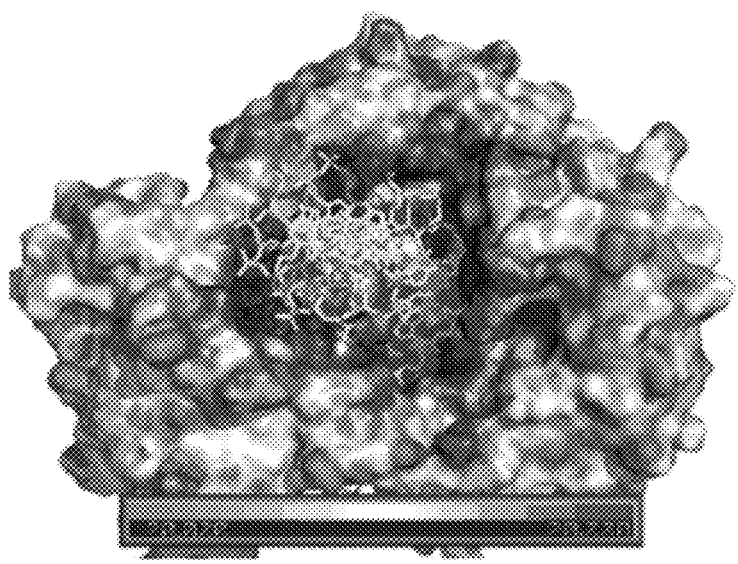
FIG. 10 Panels A and B depict the electrostatic surface of Φ29 polymerase in contact with the DNA. Positive charge is dark gray and negative charge is light gray; the intensity of the color represents the strength of the charge. The wild type of positively charged group two residues and the alanine mutants of group one residues are colored in the same scale in Panels A and B, respectively. The DNA binding interface is mainly positively charged. The positive charge on the DNA binding interface is significantly decreased after the mutation of group two residues to alanine.
Figure 10B:
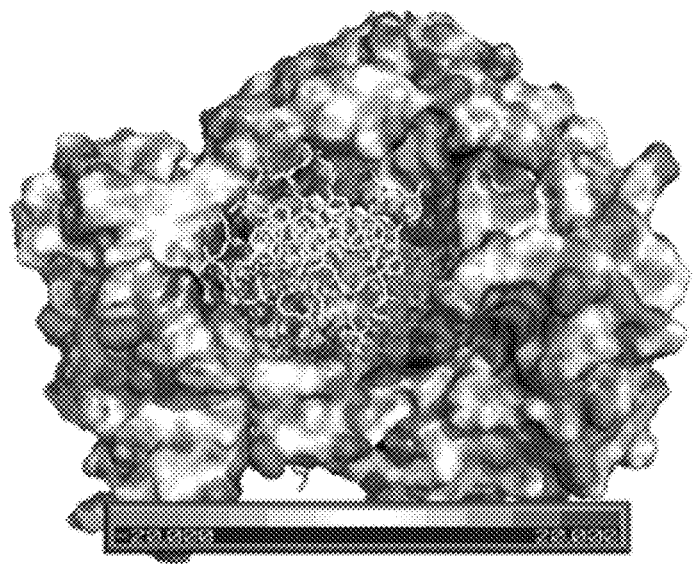
Figure 28:
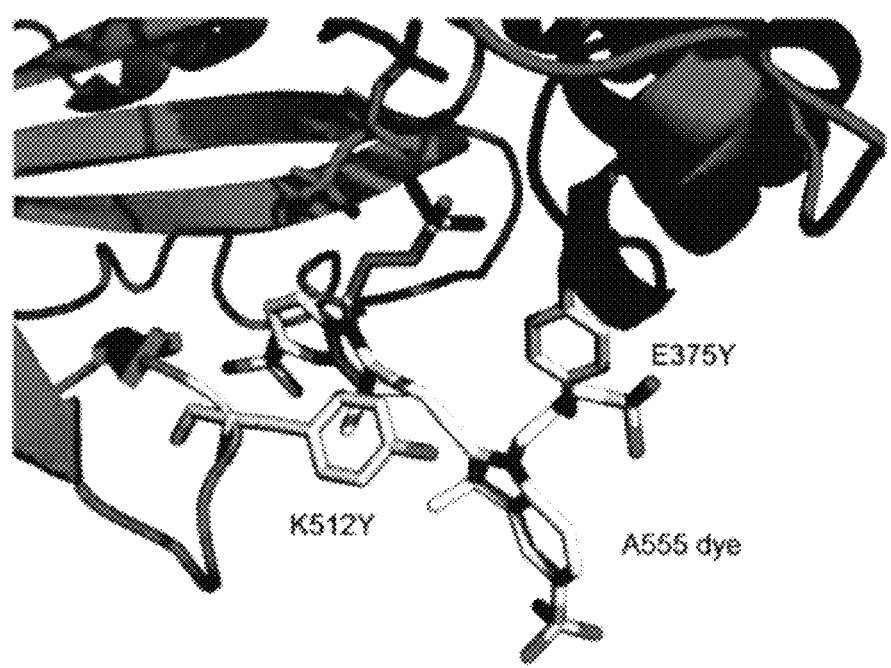
FIG. 28 depicts interaction of the A555 dye with the E375Y/K512Y region in the crystal structure of a D12A/D66A/E375Y/K512Y/T368F Φ29 polymerase with the hexaphosphate analog A555-O-dG6P.

A crystal structure of a D12A/D66A/E375Y/K512Y/T368F Φ29 polymerase with DNA and the hexaphosphate analog A555-O-dG6P determined in-house demonstrates that the aromatic rings of E375Y and K512Y are proximal to each other, trapping the dye moiety of the analog (FIG. 28). Examination of the electron density map shows that E375Y has a fixed conformation but K512Y shows greater flexibility. Insertion of one or more amino acids into the 507-514 loop can give greater flexibility to the loop, permitting K512Y (or similar substitutions such as K512F) to make stronger hydrophobic interactions with the dye moiety. An exemplary mutant with two glycines inserted around K512Y has a lower $K_m$ and high specificity (Table 9). Additional exemplary mutants include 511G(Xn)512Y(Xn), where Xn represents insertion of any number of any amino acids, insertion of a glycine and a serine after each of residues 511 and 512, or insertion of a copy of residues 508-511 after 511 (duplicating the loop). Such mutations can, e.g., stabilize the closed conformation, slow product release, and/or decrease branching fraction.

to increase interaction. (Site-saturated mutagenesis to all possible residues can also be performed.) As for other strategies herein, promising mutations can be combined for greater enhancement of effect on rate. Since the residues of group ones are spread out in the region along the DNA backbone (except for the active site), mutation effect is generally addable. Virtual mutation of all residues in group one simultaneously to positively charged lysine shows a significant enhancement of electrostatic interactions between the polymerase and the DNA (FIG. 9 Panels A and B). Similarly, one or more residues from group two can be mutated, e.g., to any of the other amino acids, e.g., by site-saturated mutagenesis. Virtual mutation of all residues in group two simultaneously to uncharged alanine shows a significant decrease in electrostatic interactions between the polymerase and DNA (FIG. 10

TABLE 9

Characterization of loop insertion mutant.

| Mutation | $V_{max}$ (RFU/sec) | Km (μM) | kcat (bpm) | Specificity (kcat/Km) | BF %[a] |
|---|---|---|---|---|---|
| N62D_T368F_E375Y_511.1Gins_K512Y_512.1Gins | 12220.79 | 1.37 | 117.83 | 85.80 | 12.22 |
| N62D_T368F_E375Y_K512Y | 12187.11 | 2.21 | 117.50 | 53.15 | 9.19 |

[a]BF: branching fraction

For single molecule sequencing with phosphate-labeled analogs, the timing of polyphosphate release after nucleotidyl transfer can play an important role in detection of the event, as described above. The release of pyrophosphate is coupled with the movement of the DNA polymerase and DNA translocation (Steitz (2004) "The structural basis of the transition from initiation to elongation phases of transcription, as well as translocation and strand separation, by T7 RNA polymerase" Curr Opin Struct Biol 14(1):4-9, Steitz (2006) "Visualizing polynucleotide polymerase machines at work" EMBO J 25(15):3458-68, and Steitz and Yin (2004) "Accuracy, lesion bypass, strand displacement and translocation by DNA polymerases" Philos Trans R Soc Lond B Biol Sci 359(1441):17-23). Where translocation follows polyphosphate release, slowing translocation will increase interpulse distance and decrease the chance of merging two consecutive pulses in SMS as described herein. Where polyphosphate release is concurrent with translocation, slowing translocation will not change interpulse distance but rather pulse width, which can improve detection of pulses as described herein.

Figure 7:
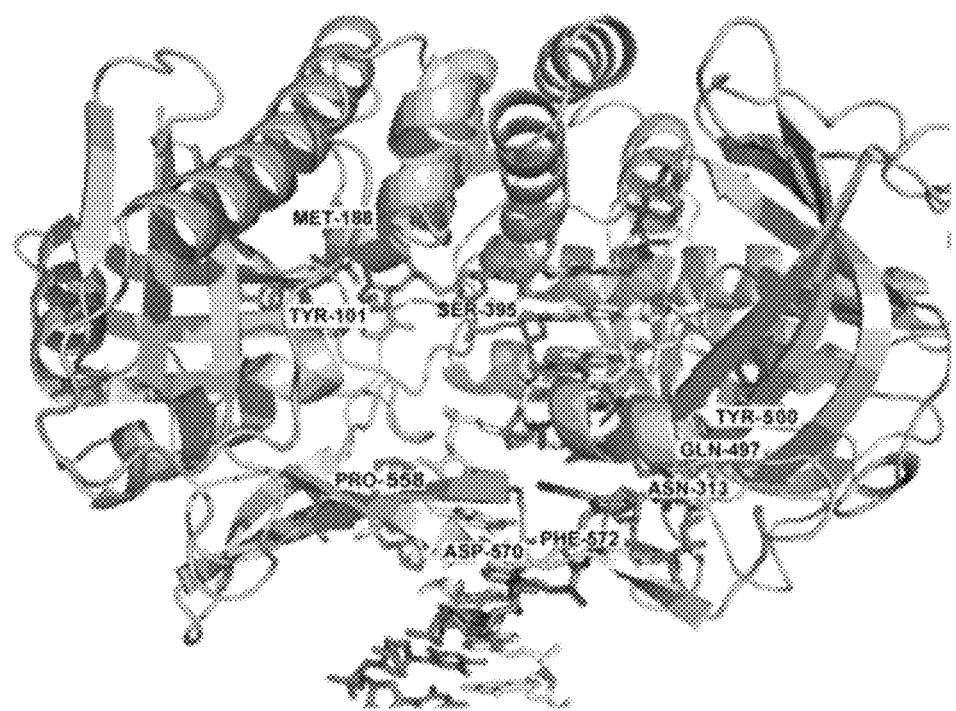
FIG. 7 presents the structure of Φ29 polymerase in complex with DNA and a nucleotide analog, showing the non-positively charged residues in group one. These residues are within 4 Å of the DNA.
Figure 8:
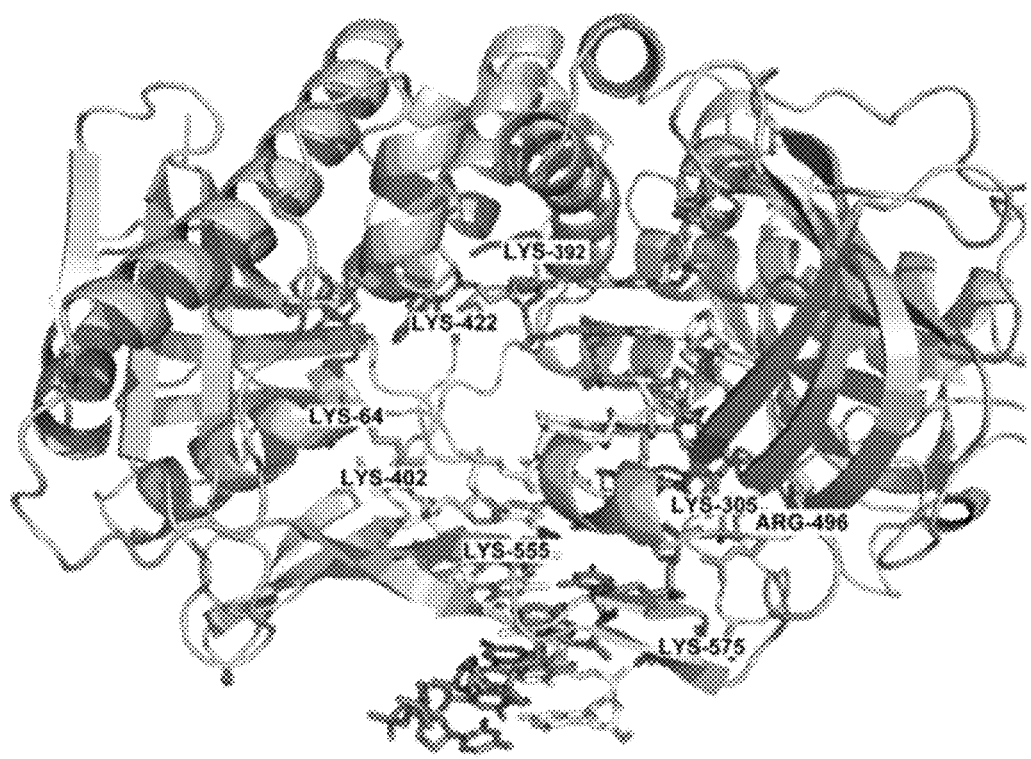
FIG. 8 presents the structure of Φ29 polymerase in complex with DNA and a nucleotide analog, showing the positively charged residues in group two. These residues are within 4 Å of the DNA and directly or indirectly interact with the DNA backbone.

Examination of an in-house crystal structure of Φ29 polymerase revealed two groups of residues within 4 Å of the DNA backbone and directly or indirectly interacting with the DNA. Residues in group one have non-positive charge: Y101, M188, T189, Q303, N313, S395, F414, Q497, Y500, A531, G532, T534, P558, D570, F572, and I574 (FIG. 7). Residues in group two have positive charge: K64, K305, K392, K402, K422, R496, K529, K538, K555, and K575 (FIG. 8). These two groups of residues exclude residues close to the enzyme's incoming deoxynucleotide binding site (active site).

Residues from either or both groups can be mutated to strengthen or weaken interactions with the DNA and thus affect translocation and/or polyphosphate release. For example, increasing DNA binding can slow translocation and pyrophosphate release, and can also increase processivity. Typically, positively charged residues are favored for DNA binding due to the negatively charged DNA backbone. Thus, one or more residue from group one can be mutated to a positively charged residue, e.g., lysine, arginine, or histidine, Panels A and B). The mutation effect for group two is also generally addable. Combinations of mutations from groups one and two are also evaluated. Residues around the active site can also control translocation, for example, tyrosines 254 and 390 and asparagine 387. Mutation of these residues can also alter DNA translocation.

Exemplary mutations include Y101K, M188K, T189K, Q303K, N313K, S395K, F414K, Q497K, Y500K, A531K G532K, T534K, P558K, D570K, F572K, I574K, K64A, K305A, K392A, K402A, K422A, R496A, K529A, K538A, K555A, and K575A. Initial experiments were performed with modified polymerases comprising the exemplary substitutions in a E375Y/K512Y/T368F Φ29 polymerase background. The initial experiments show that the polymerases including M188K, S395K, Q497K, T534K, or K575A have good specificity and branching fraction. The modified polymerases including Q303K, N313K, F414K, D570K, K392A, K402A or K422A have improved specificity, and the polymerase including K555A has improved branching fraction. A DNA dissociation assay shows that modified polymerases including Q303K, N313K, Q497K, or D570K have improved processivity, and a Cbz assay shows that the polymerase including F572K has features characteristic of slow product release. In a single molecule sequencing assay, a Q497K/ N62D/E375Y/K512Y/T368F/A484E modified Φ29 polymerase demonstrates a longer read length (indicating improved processivity consistent with the results of the DNA dissociation assay) and a faster on rate ($k_{on}$) compared to the control enzyme (N62D/E375Y/K512Y/T368F/A484E). Additional exemplary substitutions, deletions, insertions, and combinations thereof are found herein, e.g., in Table 13 and FIGS. 34-35.

As another strategy, one or more residues in the polymerase that are proximal to a phosphate on a bound nucleotide or nucleotide analog can be mutated to weaken or strengthen interaction with the phosphate (e.g., any phosphate in a tri-, tetra-, penta-, hexa-, or hepta-phosphate analog). For example, a positively charged residue that interacts with a phosphate can be mutated to an uncharged or even a negatively charged residue to weaken interactions with the phosphate, or an uncharged or negatively charged residue can be mutated to a polar uncharged residue or a positively charged residue to strengthen interaction. Such mutations can, e.g., affect release of a polyphosphate product (e.g., pyrophosphate or a longer polyphosphate, e.g., with attached label).

Figure 29:
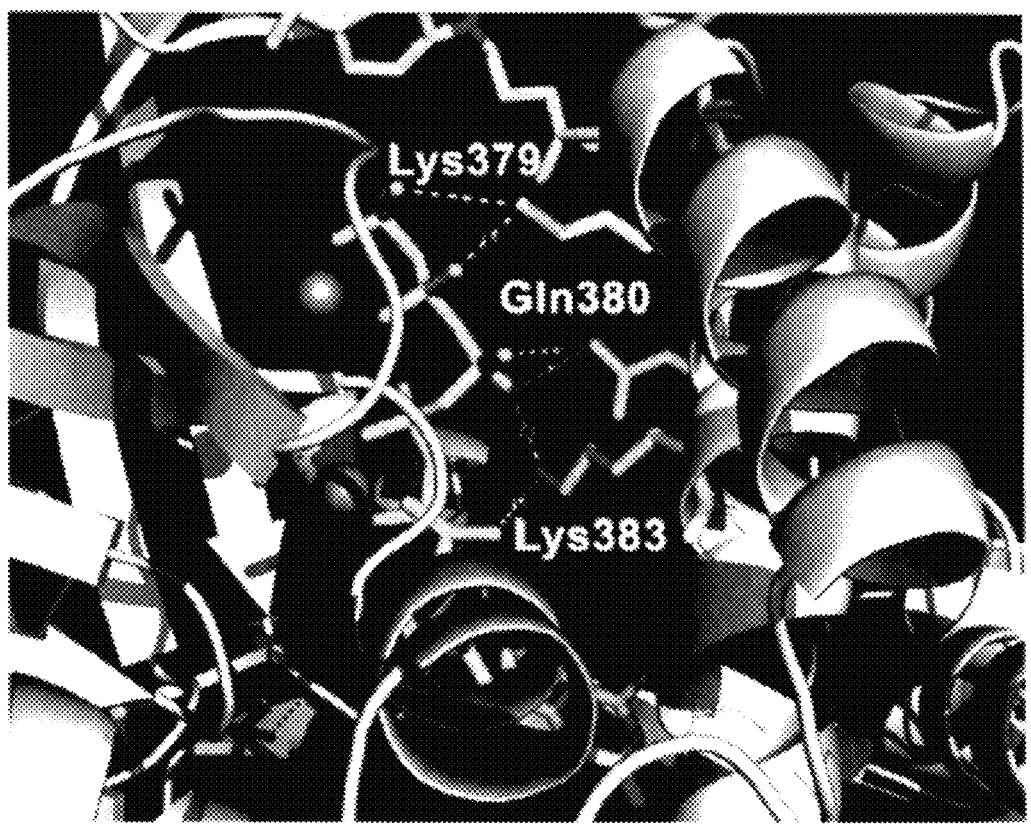
FIG. 29 depicts the location of Gln380 in Φ29 and interactions with a hexaphosphate analog.

A crystal structure of a Φ29 polymerase with a bound hexaphosphate analog determined in-house reveals that the hexaphosphate analog interacts closely with the fingers. Several positively charged residues on the finger domain (Lys383, Lys379, Lys371, and Lys361) form electrostatic interactions to the negatively charged hexaphosphate group on the analog. In addition, careful examination of the structure revealed that residue Gln380 points toward the phosphate groups (FIG. 29). Mutation of Gln380, e.g., to a charged residue, can therefore affect (e.g., increase) electrostatic interactions with the phosphate group. Exemplary mutations include Q380K, Q380R, Q380H, Q380D, and Q380E. Polymerases with a Q380K, Q380R, or Q380D substitution (in a E375Y, K512Y and T368F background) demonstrate a lower branching fraction and enhanced analog binding, and they also show slower release of polyphosphate product in a Cbz leaving pyrophosphate inhibition assay (e.g., as described hereinbelow). Without limitation to any particular mechanism, Q380K and Q380R are thought to introduce a positive charge interacting with the negatively charged phosphate groups, while Q380D introduces a negative charge that can build a metal ion coordination structure (or salt bridge, negatively charged Q380D-positively charged metal ion-negatively charged phosphate), to strengthen analog binding and slow polyphosphate release. As noted above, the hexaphosphate group on the analog also interacts with negatively charged residues in the palm domain via metal ion coordination. The Q380 substitutions are optionally used in combination with other mutations, e.g., mutations that affect metal ion coordination (e.g., A484E, S487E, etc.).

Figure 22:
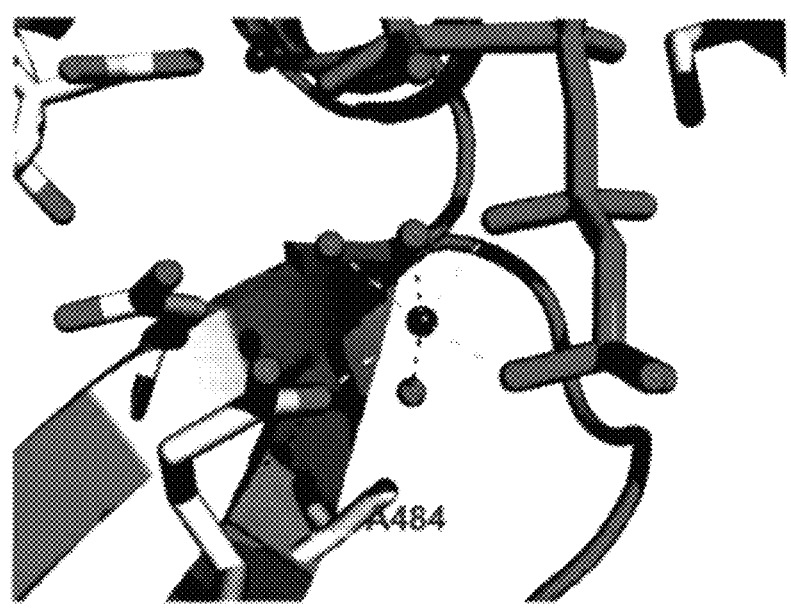
FIG. 22 illustrates third metal coordination in a crystal structure of the polymerase with DNA and hexaphosphate analog A555-O-dG6P.
Figure 23A:
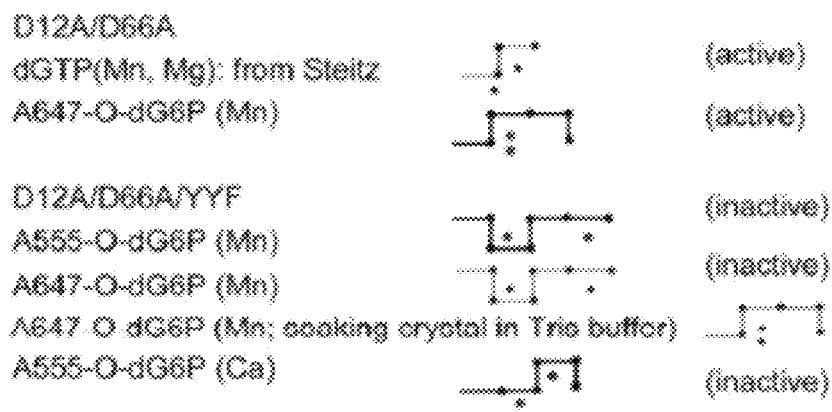
FIG. 23 Panels A-D illustrate active and inactive conformations found in crystal structures of the polymerase with hexaphosphate analogs.
Figure 23B:
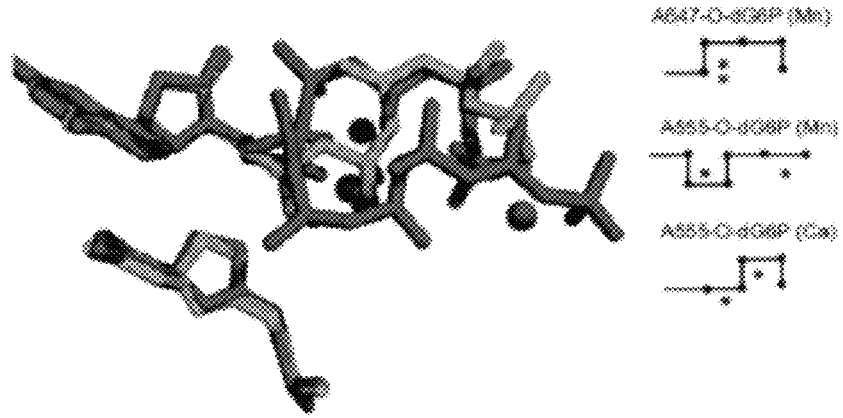
Figure 24:
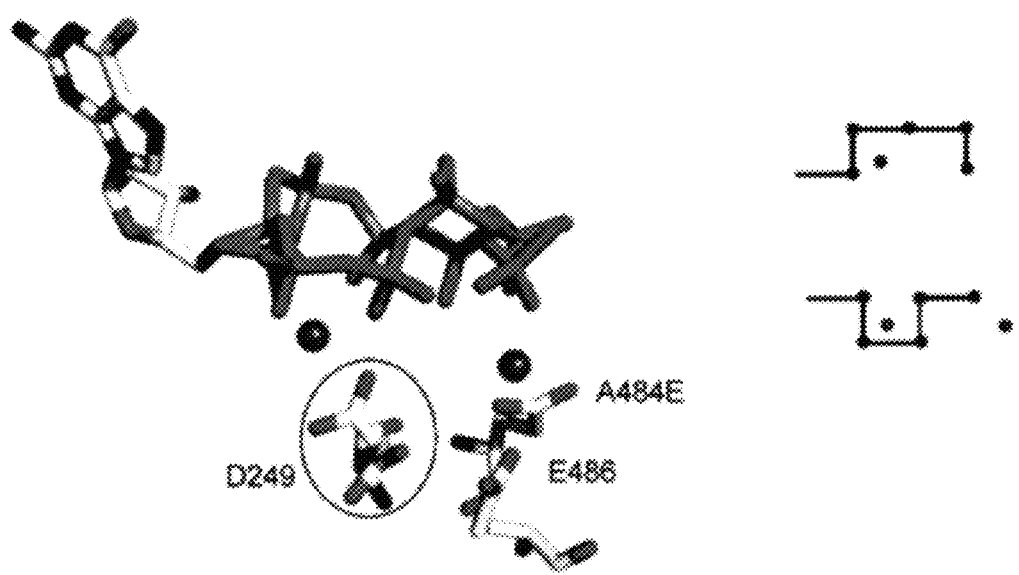
FIG. 24 illustrates two phosphate backbone and D249 side chain conformations observed in the structure of a D12A/D66A/E375Y/K512Y/T368F/A484E Φ29 polymerase with the hexaphosphate analog A555-O-dG6P.
Figure 25:
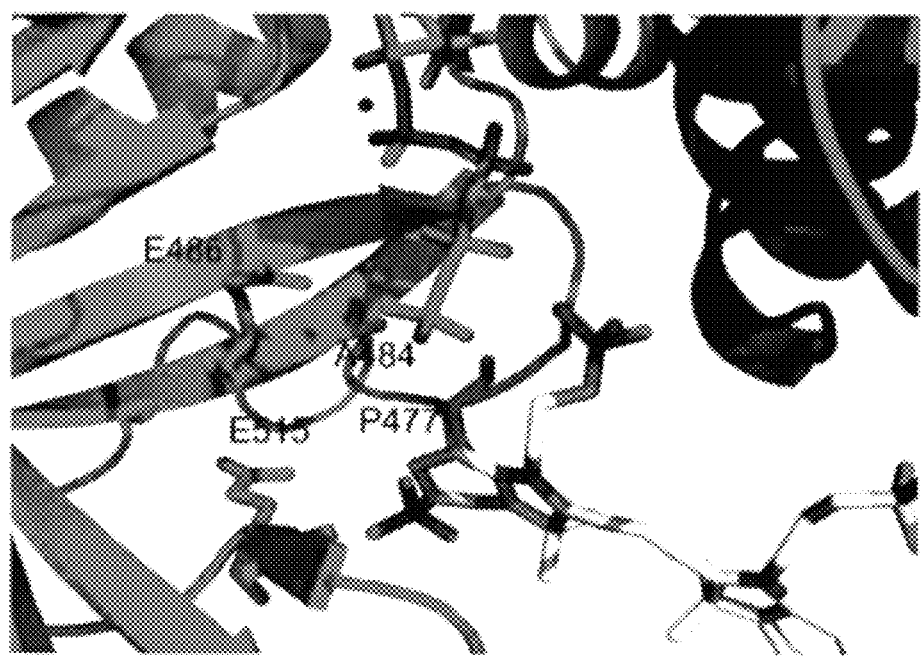
FIG. 25 illustrates how direct phosphate-palm domain interaction, without a third metal ion, can be achieved by substitution with basic amino acids.

In a related approach, residues observed to coordinate one or more additional metal ions and thus indirectly contribute to interaction with the phosphate tail of the nucleotide analog are altered to interact directly with the phosphate groups. As described above, an additional third metal ion that coordinates with the phosphate tail and the polymerase has been observed in in-house crystal structures (e.g., FIG. 22), and a mutant polymerase including an A484E substitution (expected to strengthen metal coordination) displays two slow step behavior. As shown in FIG. 23 Panels A-D, three major different phosphate backbone conformations have been observed for hexaphosphate analogs in various in-house crystal structures of Φ29 polymerase complexes with DNA and analog. One is an active conformation and two are inactive conformations based on phosphate backbone orientation. The third metal is observed in structures displaying inactive conformations. In addition, in the crystal structure of a Φ29 polymerase having D12A, D66A, E375Y, K512Y, T368F, and A484E substitutions with the hexaphosphate analog A555-O-dG6P, two alternative phosphate backbone conformations with 50% occupancy were observed (FIG. 24). In this structure, the side chain of A484E directly coordinates the third metal ion without a bridging water molecule, as expected. However, the metal coordination is not ideal, and accordingly the third metal only shows 50% occupancy in the crystal structure. Also, two alternative structures for D249 have been observed in active and inactive crystal structures.

These observations indicate that removing or weakening the third metal site may be of interest, e.g., where maintenance of the active conformation of the phosphate backbone is desirable. Coordination of the third metal can be weakened, for example, by mutation of A484 and/or E486 (which also coordinates metal C), for example, to neutral amino acids (e.g., E486A). Similarly, A484 and/or E486 can be changed to a basic amino acid, destroying coordination of the third metal but maintaining interaction with the phosphate backbone even in the absence of the metal. Examples include, but are not limited to, A484K, A484R, A484M, E486K, E486R, E486M, and combinations thereof. Modified polymerases including A484R or A484K (in a E375Y/K512Y/T368F background) exhibit a high $k_{on}$ and two slow step behavior. Additional positive charge around the location of the sixth phosphate in analogs with six or more phosphates can also be achieved, for example, by altering E515 and/or P477 (e.g., E515K, E515R, P477K, P477R, and combinations thereof), optionally in combination with mutation of residues 484 and/or 486. Additional exemplary substitutions, deletions, insertions, and combinations thereof are found in Table 13 and FIG. 34.

Mutation of residues proximal to the polyphosphate tail of a bound nucleotide or analog can affect isomerization of the polyphosphate tail, slowing nucleotide isomerization and/or polyphosphate product release. This strategy can be particularly useful for nucleotide analogs with four or more phosphate groups. During the process of DNA polymerization, a nucleotide isomerization step before the chemical reaction step has been observed and considered to be a relatively slow step compared to the initial nucleotide binding event (Dahlberg and Benkovic (1991) "Kinetic mechanism of DNA polymerase I (Klenow fragment): Identification of a second conformational change and evaluation of the internal equilibrium constant" Biochemistry 30(20):4835-43, Patel et al. (1991) "Pre-steady-state kinetic analysis of processive DNA replication including complete characterization of an exonuclease-deficient mutant" Biochemistry 30(2):511-25, Hsieh et al. (1993) "Kinetic mechanism of the DNA-dependent DNA polymerase activity of human immunodeficiency virus reverse transcriptase" J. Biol. Chem. 268(33):24607-13, Washington et al. (2001) "Yeast DNA polymerase eta utilizes an induced-fit mechanism of nucleotide incorporation" Cell 107(7):917-27, and Anand and Patel (2006) "Transient state kinetics of transcription elongation by T7 RNA polymerase" J. Biol. Chem. 281(47):35677-85).

Figure 5A:
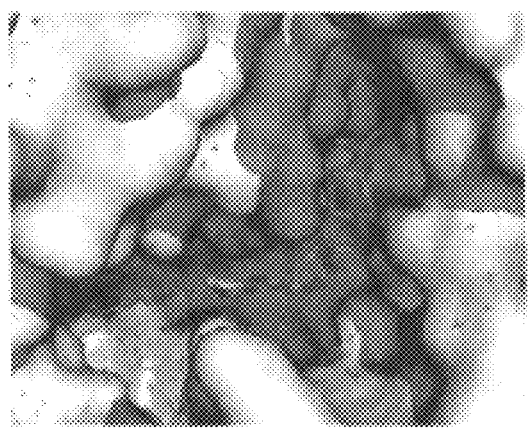
FIG. 5 illustrates the structure of a Φ29 polymerase ternary complex with the polyphosphate tail of the nucleotide analog in the active conformation with tight binding (Panel A) and in the inactive conformation with loose binding (Panel B).
Figure 5B:
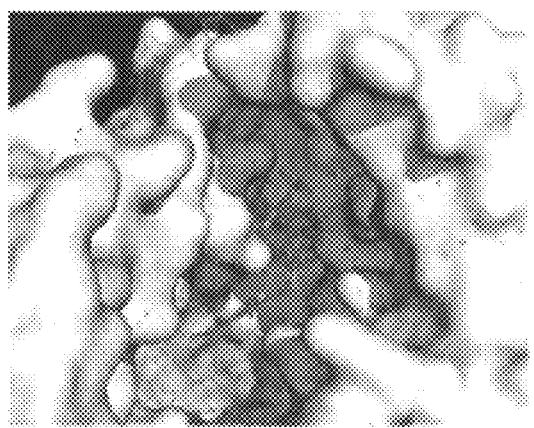

A group of DNA polymerase ternary complexes with the nucleoside polyphosphate tail in different conformations were determined by x-ray crystallography (Vaisman et al. (2005) "Fidelity of Dpo4: Effect of metal ions, nucleotide selection and pyrophosphorolysis" EMBO J 24(17):2957-67, and in-house crystal structures of Φ29 complexes). Crystal structures of Φ29 polymerase with a hexaphosphate analog determined in house reveal both active (FIG. 5 Panel A) and inactive (FIG. 5 Panel B) conformations of the polyphosphate tail on the incoming nucleotide analog. Comparison of the two ternary structures revealed that binding of the nucleotide analog is tighter in the active conformation than in the inactive conformation (FIG. 5 Panels A and B). The loose binding of the inactive hexaphosphate tail provides necessary space for sampling multiple inactive conformations and finally achieving the active conformation which leads to the chemical reaction. Increasing the multiplicity of the inactive conformations or stabilizing a certain inactive conformation can extend the isomerization time of the analog before the chemical reaction occurs. Mutants that do so without increasing branching fraction are preferred.

Superposition of the active and inactive conformation structures revealed two residues, Lys383 and Asp458, on the two sides of the beta phosphate that provide limitation between the active and inactive conformational change.

Figure 6:
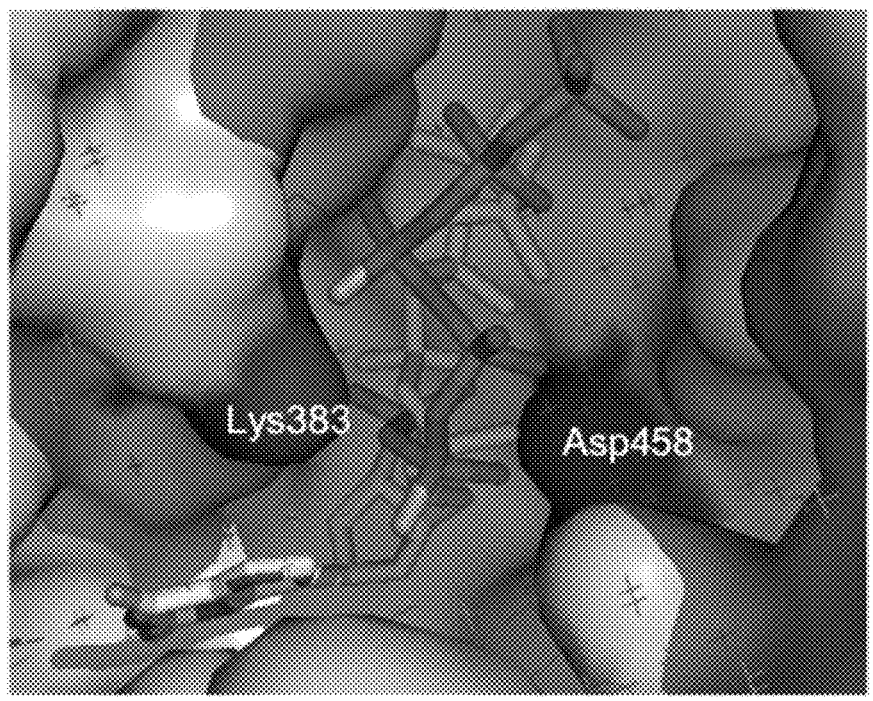
FIG. 6 shows a superimposition of the structure of the polymerase ternary complex with the active polyphosphate conformation and the structure with the inactive polyphosphate conformation. The polymerase surface with the inactive polyphosphate conformation is shown. Two residues (Lys383 and Asp458) which act as a "clamp" (possible steric hindrance) between the active and inactive conformations are labeled.

These two residues act as a "clamp" which introduces possible steric hindrance for the polyphosphate isomerization (FIG. 6). Decreasing the residue size at either or both of these two positions (especially position 383) can decrease the branching fraction. Mutating these residues can also increase the multiplicity of the inactive conformation, extending the isomerization time. Two other residues, Lys371 and Lys379, also interact with the polyphosphate tail. Mutation of these residues (e.g., to another positively charged residue or an uncharged residue) can also affect isomerization control. Note that Asp458 is in the polymerase active site, and mutating this residue may thus have undesirable effects on enzyme activity. The other three lysines provide a positively charged binding environment for the negatively charged polyphosphate tail. Severely changing the polarity of this binding pocket may disrupt accommodation of the analog, so mutation to other positively charged residues or to uncharged residues is typically preferred.

Residues that can be mutated to affect interactions with phosphates include, e.g., 251, 371, 379, 380, 383, 458, 484, and 486. Exemplary substitutions include 251E, 251K, 251R, 251H, 251Q, 251D, 371A, 371W, 371L, 371H, 371R, 371N, 371Q, 379L, 379H, 379R, 379N, 379Q, 380R, 380H, 380K, 383L, 383H, 383R, 383Q, 383N, 383T, 383S, 383A, 484K, 484R, 486A, and 486D. Additional exemplary substitutions, deletions, insertions, and combinations thereof, are found in Table 13 and FIG. 34. Site saturated mutagenesis, in which each of the other nineteen amino acids is substituted for the residue occupying a given position can also be performed at one or more of these positions, e.g., 383 or the others listed (and/or at essentially any of the positions noted elsewhere herein).

In a related strategy, the polymerase can be modeled with a polyphosphate in the binding pocket, e.g., through crystallographic study or molecular modeling. The polymerase can be mutated to alter isomerization of the polyphosphate product and thus slow its release. The length and/or chemical structure of the tail can also be modified to alter isomerization. Altering isomerization of the polyphosphate product can avoid inadvertently increasing branching fraction. Similarly, the polymerase can be mutated to strengthen binding to the polyphosphate product but not to the phosphate groups of the incoming nucleotide, which again can slow product release without reducing specificity and increasing branching fraction.

As one example of such design, molecular modeling was initiated using two in-house crystal structures of the ternary complex of Φ29 polymerase, representing the closed conformation and having a different conformation of the phosphate groups on the hexaphosphate analog, and a crystal structure of a binary complex (obtained from the Protein Data Bank, PDB ID 2PZS), representing the open conformation. To model the leaving penta-pyrophosphate analog in the closed conformation, the first phosphodiester bond between P-alpha and P-beta was broken. The deoxynucleotide in the analog was modeled to be covalently linked to the primer deoxynucleoside. The leaving penta-pyrophosphate was hydrolyzed and left in the same position to yield the starting point of the simulation. For modeling of the polymerase in the open conformation with the leaving penta-pyrophosphate, a ternary complex was superimposed on the binary complex before the operation of the chemical reaction.

Figure 30:
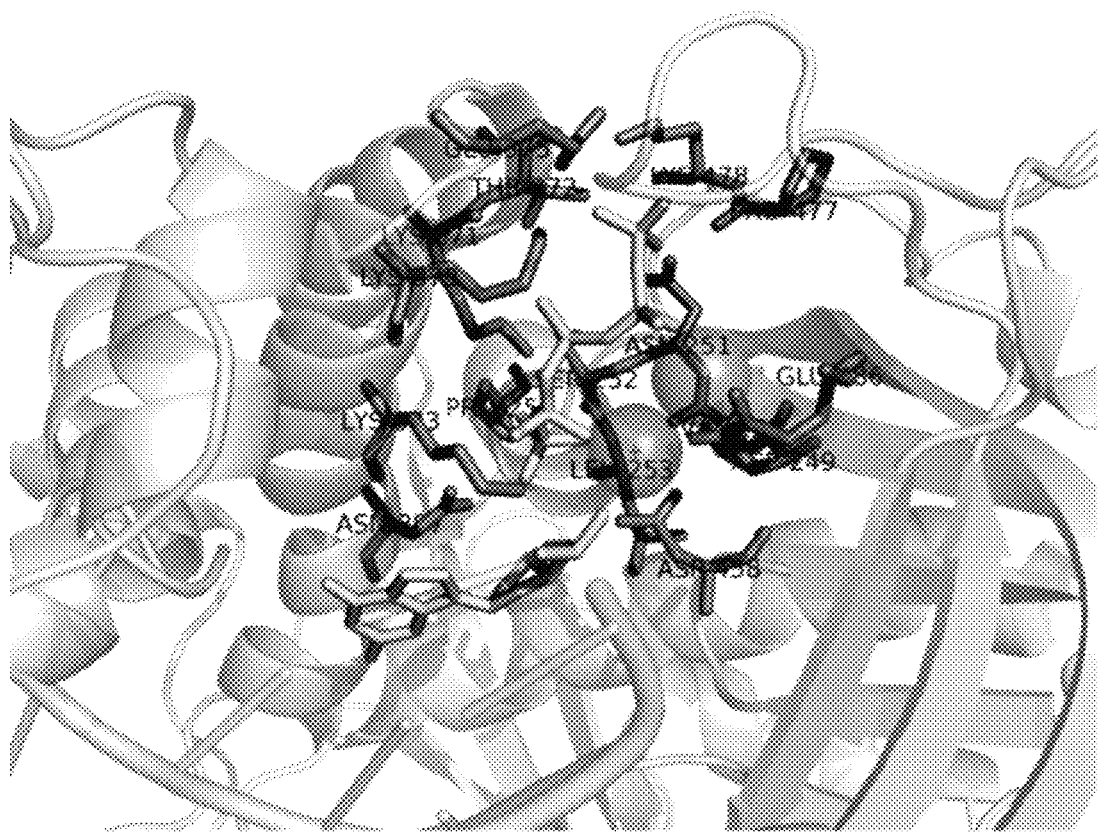
FIG. 30 depicts the leaving penta-pyrophosphate in one of the two closed conformation models. Residues interacting with the penta-pyrophosphate are also highlighted.
Figure 31:
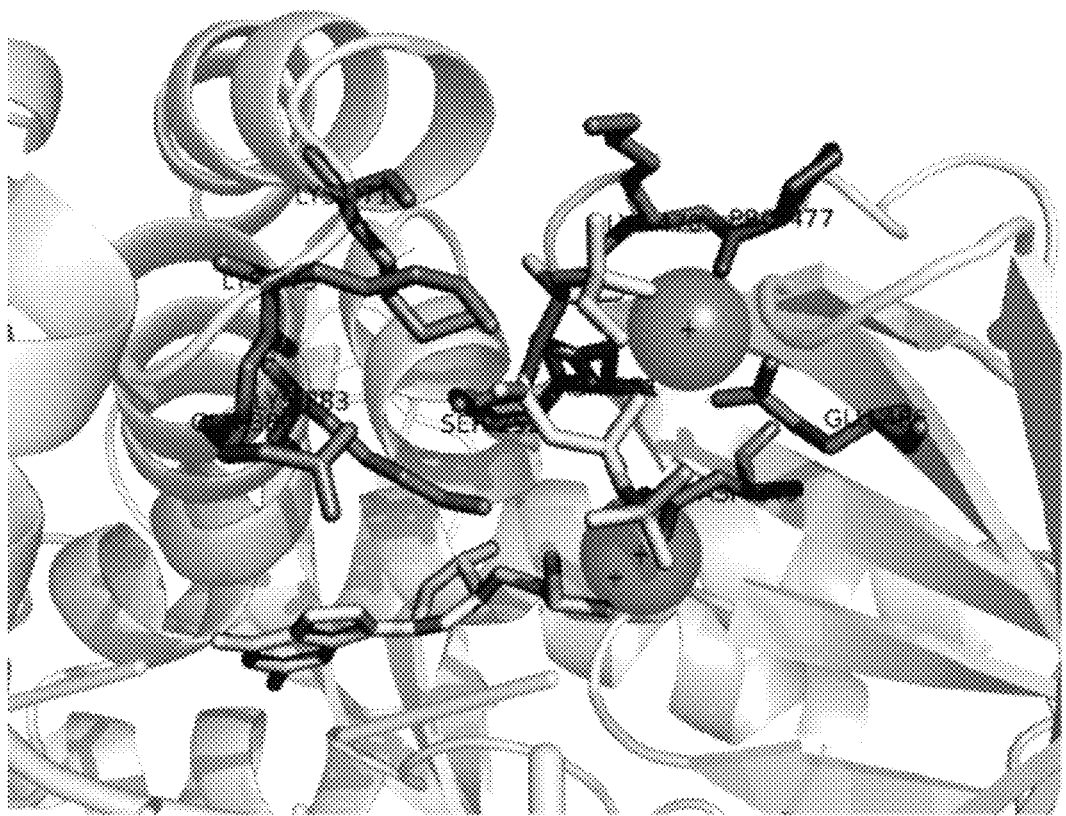
FIG. 31 depicts the leaving penta-pyrophosphate in the other of the two closed conformation models. Residues interacting with the penta-pyrophosphate are also highlighted.
Figure 32:
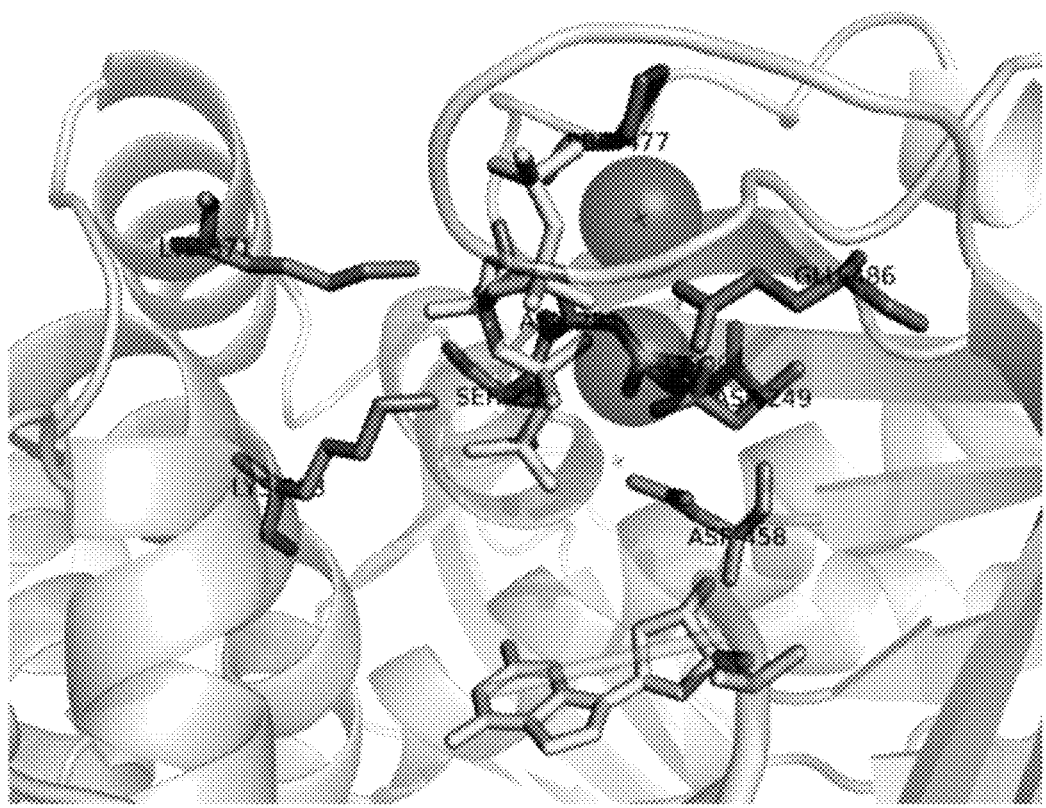
FIG. 32 depicts the leaving penta-pyrophosphate in the open conformation model. Residues interacting with the penta-pyrophosphate are also highlighted.
Figure 33:
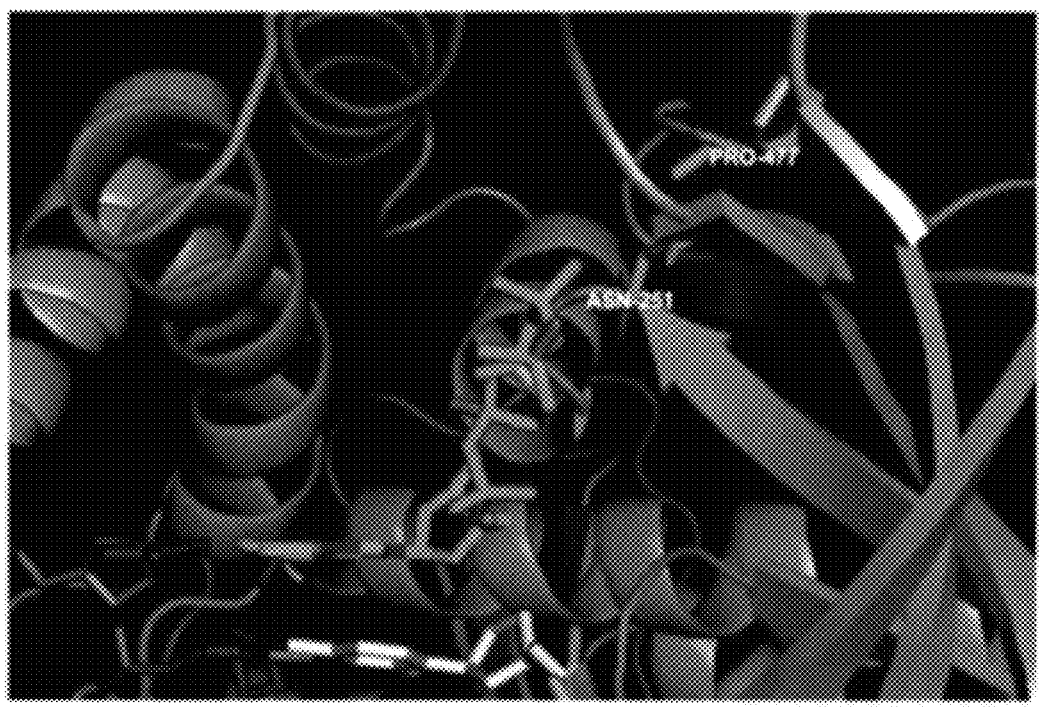
FIG. 33 depicts the location of N251 and P477.

Molecular dynamics simulations were performed on the three models. After the simulation, the penta-pyrophosphate reoriented to different locations in all three cases. Residues interacting with the penta-pyrophosphate in all three resulting models were selected. In all three cases, N251 and P477 interact with the leaving penta pyrophosphate (FIGS. 30-32).

In addition, P477 does not have any interactions with the phosphate groups in the analog-bound closed conformation before the chemical reaction and N251 has only weak interactions with the phosphate groups in one closed conformation model before the reaction, making these residues highly suitable for mutation to affect polyphosphate release without reducing specificity or increasing branching fraction. Exemplary substitutions include N251K, N251Q, N251D, P477K, P477Q, P477D, P477E, P477R, and P477H. A modified polymerase including P477D displays a significantly lower branching fraction than the parental polymerase (N62D/E375Y/K512Y/T368F), while modified polymerases including N251K, N251Q, P477K, or P477Q have better specificity and a reasonable branching fraction. Additional exemplary substitutions, deletions, insertions, and combinations thereof are found in Table 13 and FIG. 34.

Figure 41A:
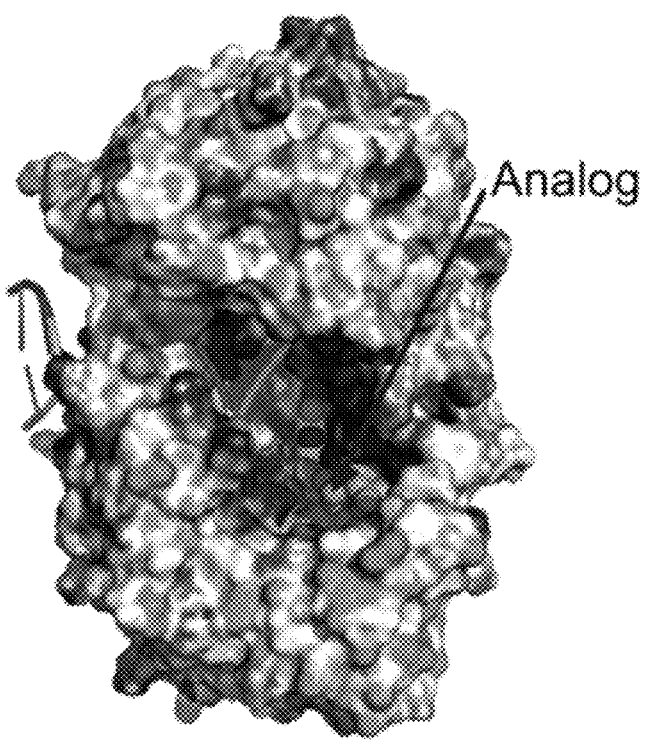
FIG. 41 Panel A depicts the electrostatic surface of Φ29 polymerase around the analog binding site. Panel B depicts the location of exemplary residues that can be mutated to affect polymerase speed.
Figure 41B:
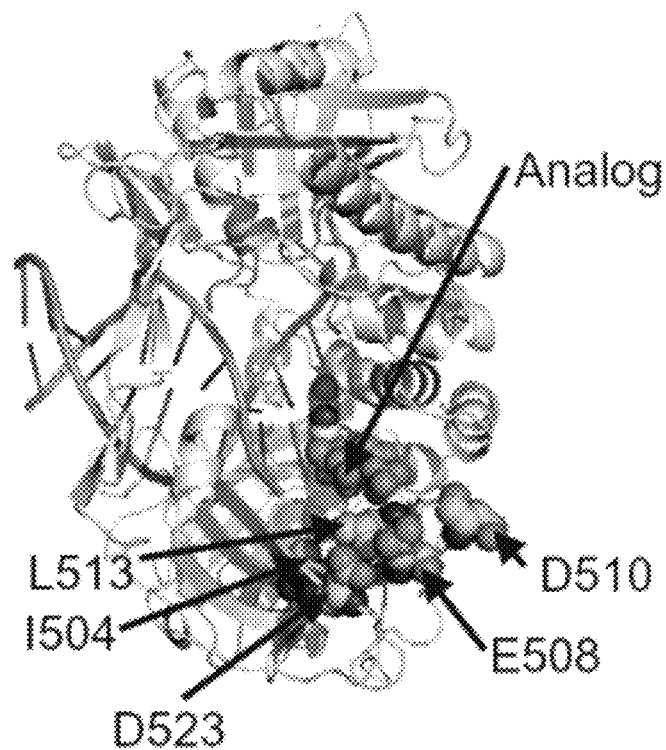

Recombinant polymerases with increased speed and readlength are desirable for applications such as sequencing. One strategy for producing such polymerases is illustrated in FIG. 41. Panel A illustrates the electrostatic surface of Φ29 polymerase at the analog binding pocket. Panel B shows the location of residues I504, E508, D510, L513, and D523. Mutation of one or more of these residues so as to increase the net positive charge of the polymerase in this region can increase polymerase speed, for example, by increasing the $k_{on}$ for negatively charged nucleotide analogs. Thus, mutation of one or more of these residues to a positively charged residue (e.g., arginine, lysine, or histidine) and/or replacement of one or more negatively charged residue with an uncharged residue (e.g., introduction of a D510Y substitution) can increase polymerase speed.

For example, a D510K substitution can increase readlength and speed in single molecule sequencing reactions by narrowing interpulse distances. However, this mutation also can decrease protein yield significantly. See, e.g., FIG. 40. As another example, an E508K or E508R substitution can increase speed by decreasing interpulse distance (but can increase undesirable pausing). Combinations of D510K and E508K or E508R can exhibit additive effects in the reduction of interpulse distances.

Figure 42A:
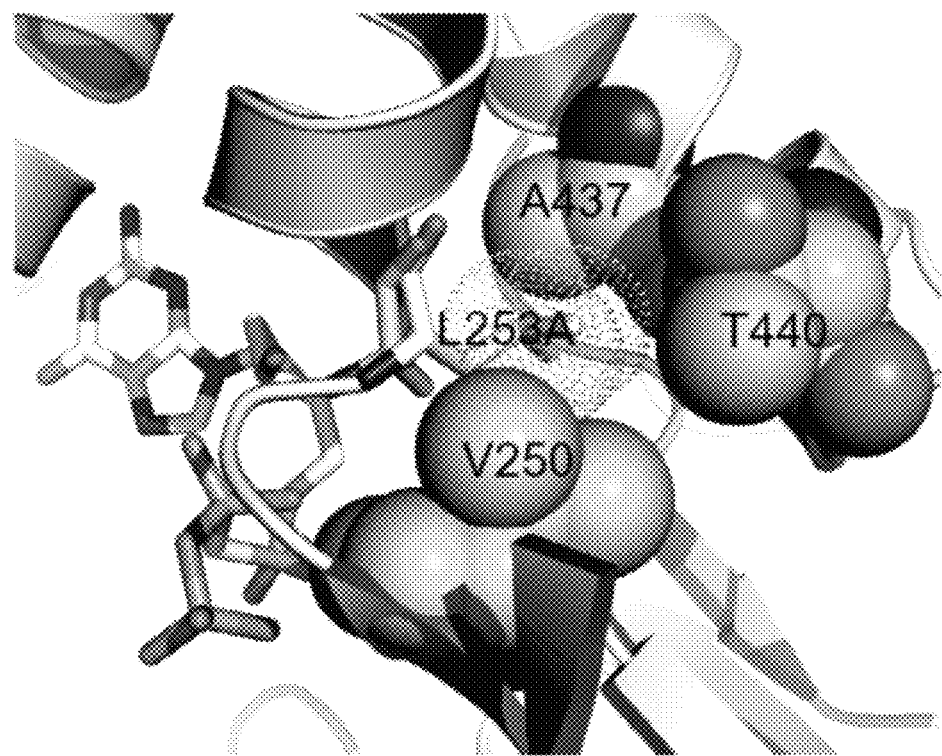
FIG. 42 Panel A depicts packing in the vicinity of residue 253 in an L253A Φ29 mutant polymerase whose structure was determined to 1.45 Å resolution with an $R_{free}$ of 19.1%. Panel B depicts a 2FoFc electron density map contoured at 1.5σ.
Figure 42B:
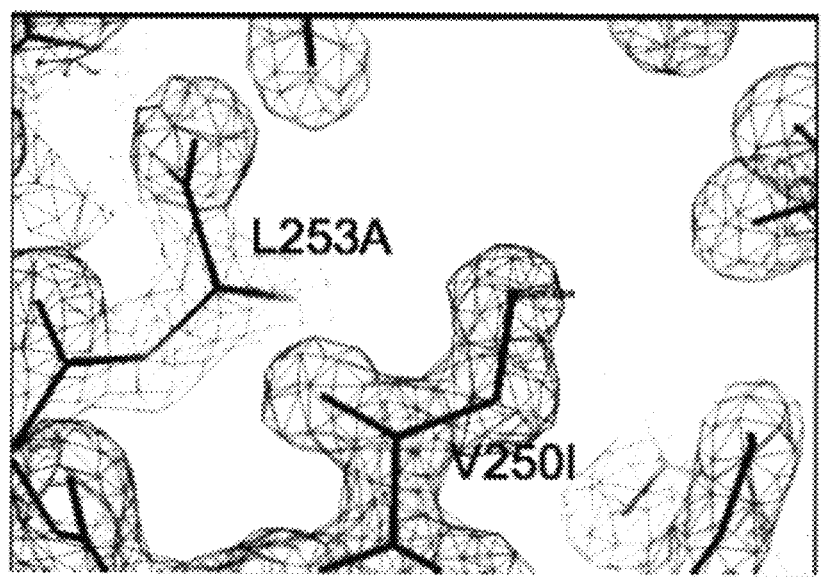

As described above, an L253A substitution can be used to increase $Mg^{++}$ tolerance. However, packing of the residues surrounding the alanine in an in-house crystal structure of a recombinant polymerase comprising an L253A substitution does not appear to be optimal, as illustrated in FIG. 42 Panels A and B. Mutation of the surrounding residues can improve packing in this region. For example, V250 can be mutated. Exemplary substitutions include V250I, V250Q, V250L, V250M, V250C, V250F, V250N, V250R, V250T, and V250Y. A V250I substitution, for example, can improve protein yield approximately 1.6 fold, and can also increase speed by narrowing pulse width and reduce pausing.

Figure 36A:
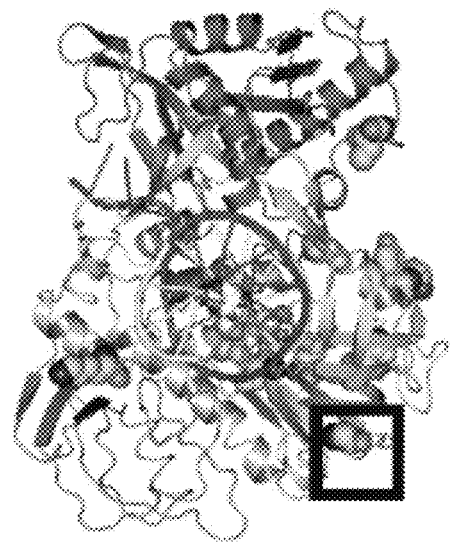
FIG. 36 Panel A depicts a Φ29 complex, highlighting the location of residue E239. Panel B shows a close-up view of the type II turn that includes E239.
Figure 36B:
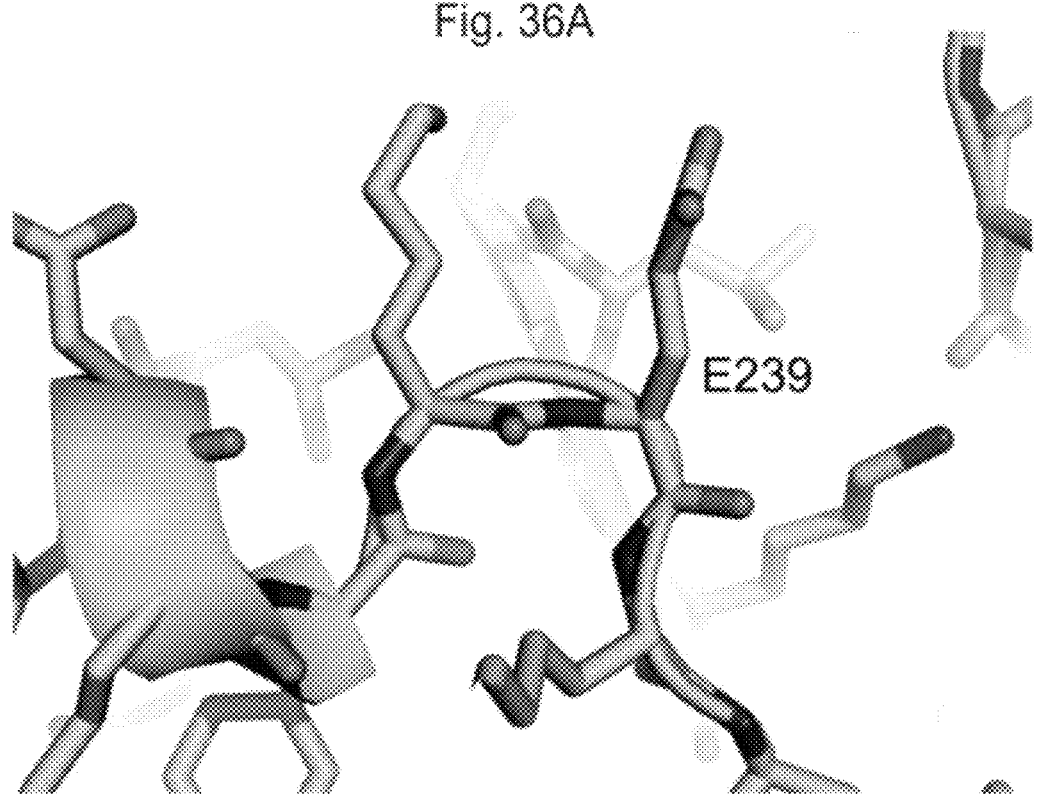

Mutations that increase thermostability and/or improve yield are desirable, for example, as described above for combination with mutations that confer other desirable properties but that decrease stability and/or yield. In one exemplary strategy for improving yield and stability, position E239 of Φ29 was identified as a target for mutation. As shown in FIG. 36 Panels A and B, E239 is located in a type II turn. Across a variety of proteins, however, statistically glycine is preferred at this position in type II turns. An E239G substitution was introduced into Φ29 polymerase accordingly. The E239G substitution can increase protein yield approximately twofold in a diverse set of variants. Moreover, since residue 239 is distal to the analog and nucleic acid binding sites, the E239G substitution does not affect sequencing kinetics.

Consensus-Based Design of Recombinant Polymerases

Figure 37B:
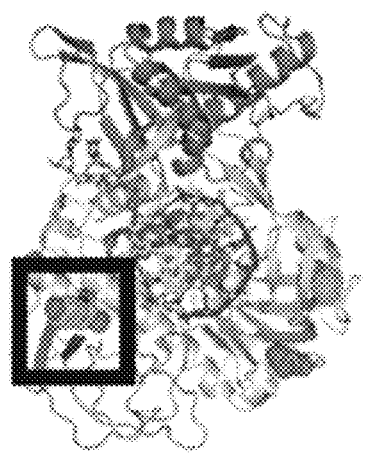
FIG. 37 Panel A shows an alignment of the amino acid sequences of Φ29, M2Y, GA-1, and AV-1 polymerases in the vicinity of residue 224 (identified with respect to Φ29). The alignment includes residues 218-229 of SEQ ID NO:1, residues 215-226 of SEQ ID NO:2, residues 218-229 of SEQ ID NO:4, and residues 230-241 of SEQ ID NO:5. Panel B depicts an in-house crystal structure of a Φ29 complex including a Y224K substitution, determined at 2.15 Å resolution with an $R_{free}$ of 21.6%. The location of residue 224 is highlighted. Panel C shows a superposition of the structures of wild-type and the Y224K mutant Φ29 complex in the region of residue 224. A hydrogen bond is formed with E221 in the Y224K mutant polymerase (dashed line from K224 to E221) that is not seen in the wild-type polymerase (Y224).
Figure 37C:
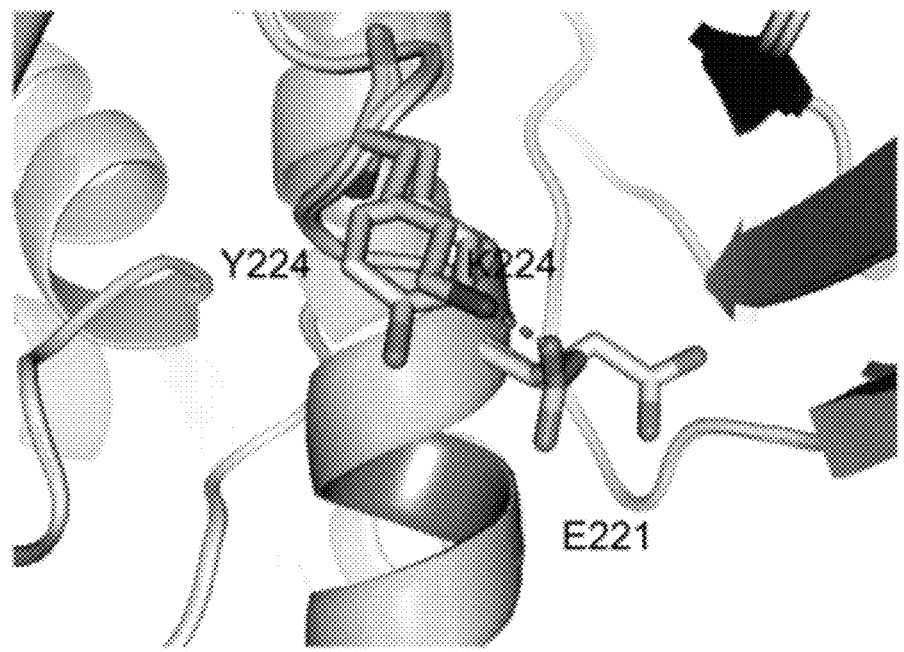

Amino acid sequence data, e.g., for a family of polymerases, can also be used to identify particular residues as candidates for mutagenesis. For example, as shown in FIG. 37 Panel A, alignment of the sequences of several polymerases revealed that Φ29-type DNA polymerases have a lysine at position 224 more often than a tyrosine.

A Y224K substitution was introduced into Φ29 accordingly. This substitution can increase thermostability, e.g., increasing unfolding temperature by about one degree when introduced into an N62D Φ29 backbone. The substitution can also increase protein yield in high throughput purification procedures by approximately fourfold.

Comparison of the crystal structures of Φ29 polymerases with and without the Y224K substitution indicated that residue E221 moves to form a hydrogen bond with K224 in the Y224K variant structure (FIG. 37 Panels B and C), suggesting a structural basis for the observed increase in stability.

Combining Mutations

As noted repeatedly, the various mutations described herein can be combined in recombinant polymerases of the invention. Combination of mutations can be random, or more desirably, guided by the properties of the particular mutations and the characteristics desired for the resulting polymerase. Additional mutations can also be introduced into a polymerase to compensate for deleterious effects of otherwise desirable mutations.

A large number of exemplary mutations and the properties they confer have been described herein, and it will be evident that these mutations can be favorably combined in many different combinations. Exemplary combinations have also been provided herein, e.g., in Tables 1-9, 13, and 16 and FIGS. 34 and 35, and an example of strategies by which additional favorable combinations are readily derived follows. For the sake of simplicity, exemplary combinations using only a few mutations are discussed, but it will be evident that any of the mutations described herein can be employed in such strategies to produce polymerases with desirable properties.

For example, where a recombinant polymerase is desired to incorporate phosphate-labeled phosphate analogs in a $Mg^{++}$-containing single molecule sequencing reaction, one or more substitutions that enhance analog binding (e.g., E375Y, K512Y, and/or A484E) and one or more substitutions that alter metal cofactor usage (e.g., L253A) can be incorporated. Exemplary combinations thus include L253A and A484E; L253A, E375Y, and K512Y; and L253A, E375Y, A484E, and K512Y. Polymerase speed can be enhanced by inclusion of substitutions such as D510K and/or V250I, providing combinations such as L253A, A484E, and D510K; Y148I, L253A, and A484E; L253A, E375Y, A484E, D510K, and K512Y; Y148I, L253A, E375Y, A484E, D510K, and K512Y; and Y148I, L253A, E375Y, A484E, and K512Y. Stability and/or yield can be increased by inclusion of substitutions such as E239G, V250I, and/or Y224K, producing combinations such as E239G, L253A, A484E, and D510K; E239G, L253A, E375Y, A484E, D510K, and K512Y; and Y224K, E239G, L253A, E375Y, A484E, D510K, and K512Y. Accuracy can be enhanced by inclusion of substitutions such as E515Q and/or Y148I (which also decreases exonuclease activity), providing combinations such as Y148I, Y224K, E239G, V250I, L253A, E375Y, A484E, D510K, and K512Y; and Y148I, Y224K, E239G, V250I, L253A, E375Y, A484E, D510K, K512Y, and E515Q. Many other such recombinant polymerases, including these mutations and/or those described elsewhere herein, will be readily apparent and are features of the invention.

Mutating Polymerases

Various types of mutagenesis are optionally used in the present invention, e.g., to modify polymerases to produce variants, e.g., in accordance with polymerase models and model predictions as discussed above, or using random or semi-random mutational approaches. In general, any available mutagenesis procedure can be used for making polymerase mutants. Such mutagenesis procedures optionally include selection of mutant nucleic acids and polypeptides for one or more activity of interest (e.g., reduced reaction rates, decreased exonuclease activity, increased complex stability, decreased branching fraction, altered metal cofactor selectivity, improved processivity, increased thermostability, increased yield, increased accuracy, and/or improved $k_{off}$, $K_m$, $V_{max}$, $K_{cat}$ etc., e.g., for a given nucleotide analog). Procedures that can be used include, but are not limited to: site-directed point mutagenesis, random point mutagenesis, in vitro or in vivo homologous recombination (DNA shuffling and combinatorial overlap PCR), mutagenesis using uracil containing templates, oligonucleotide-directed mutagenesis, phosphorothioate-modified DNA mutagenesis, mutagenesis using gapped duplex DNA, point mismatch repair, mutagenesis using repair-deficient host strains, restriction-selection and restriction-purification, deletion mutagenesis, mutagenesis by total gene synthesis, degenerate PCR, double-strand break repair, and many others known to persons of skill. The starting polymerase for mutation can be any of those noted herein, including available polymerase mutants such as those identified e.g., in WO 2007/076057 POLYMERASES FOR NUCLEOTIDE ANALOGUE INCORPORATION by Hanzel et al.; WO 2008/051530 POLYMERASE ENZYMES AND REAGENTS FOR ENHANCED NUCLEIC ACID SEQUENCING; Hanzel et al. WO 2007/075987 ACTIVE SURFACE COUPLED POLYMERASES; and Hanzel et al. WO 2007/076057 PROTEIN ENGINEERING STRATEGIES TO OPTIMIZE ACTIVITY OF SURFACE ATTACHED PROTEINS.

Optionally, mutagenesis can be guided by known information from a naturally occurring polymerase molecule, or of a known altered or mutated polymerase (e.g., using an existing mutant polymerase as noted in the preceding references), e.g., sequence, sequence comparisons, physical properties, crystal structure and/or the like as discussed above. However, in another class of embodiments, modification can be essentially random (e.g., as in classical or "family" DNA shuffling, see, e.g., Crameri et al. (1998) "DNA shuffling of a family of genes from diverse species accelerates directed evolution" Nature 391:288-291).

Additional information on mutation formats is found in: Sambrook et al., *Molecular Cloning—A Laboratory Manual* (3rd Ed.), Vol. 1-3, Cold Spring Harbor Laboratory, Cold Spring Harbor, N.Y., 2000 ("Sambrook"); *Current Protocols in Molecular Biology*, F. M. Ausubel et al., eds., Current Protocols, a joint venture between Greene Publishing Associates, Inc. and John Wiley & Sons, Inc., (supplemented through 2011) ("Ausubel")) and *PCR Protocols A Guide to Methods and Applications* (Innis et al. eds) Academic Press Inc. San Diego, Calif. (1990) ("Innis"). The following publications and references cited within provide additional detail on mutation formats: Arnold, Protein engineering for unusual environments, Current Opinion in Biotechnology 4:450-455 (1993); Bass et al., Mutant Trp repressors with new DNA-binding specificities, Science 242:240-245 (1988); Bordo and Argos (1991) Suggestions for "Safe" Residue Substitutions in Site-directed Mutagenesis 217:721-729; Botstein & Shortle, Strategies and applications of in vitro mutagenesis, Science 229:1193-1201 (1985); Carter et al., Improved oligonucleotide site-directed mutagenesis using M13 vectors, Nucl. Acids Res. 13: 4431-4443 (1985); Carter, Site-directed mutagenesis, Biochem. J. 237:1-7 (1986); Carter, Improved oligonucleotide-directed mutagenesis using M13 vectors, Methods in Enzymol. 154: 382-403 (1987); Dale et al., Oligonucleotide-directed random mutagenesis using the phosphorothioate method, Methods Mol. Biol. 57:369-374 (1996); Eghtedarzadeh & Henikoff, Use of oligonucleotides to generate large deletions, Nucl. Acids Res. 14: 5115 (1986); Fritz et al., Oligonucleotide-directed construction of mutations: a gapped duplex DNA procedure without enzymatic reactions in vitro, Nucl. Acids Res. 16: 6987-6999 (1988); Grundström et al., Oligonucleotide-directed mutagenesis by microscale 'shot-gun' gene synthesis, Nucl. Acids Res. 13: 3305-3316 (1985); Hayes (2002) Combining Computational and Experimental Screening for rapid Optimization of Protein Properties PNAS 99(25) 15926-15931; Kunkel, The efficiency of oligonucleotide directed mutagenesis, in Nucleic Acids & Molecular Biology (Eckstein, F. and Lilley, D. M. J. eds., Springer Verlag, Berlin)) (1987); Kunkel, Rapid and efficient site-specific mutagenesis without phenotypic selection, Proc. Natl. Acad. Sci. USA 82:488-492 (1985); Kunkel et al., Rapid and efficient site-specific mutagenesis without phenotypic selection, Methods in Enzymol. 154, 367-382 (1987); Kramer et al., The gapped duplex DNA approach to oligonucleotide-directed mutation construction, Nucl. Acids Res. 12: 9441-9456 (1984); Kramer & Fritz Oligonucleotide-directed construction of mutations via gapped duplex DNA, Methods in Enzymol. 154:350-367 (1987); Kramer et al., Point Mismatch Repair, Cell 38:879-887 (1984); Kramer et al., Improved enzymatic in vitro reactions in the gapped duplex DNA approach to oligonucleotide-directed construction of mutations, Nucl. Acids Res. 16: 7207 (1988); Ling et al., Approaches to DNA mutagenesis: an overview, Anal Biochem. 254(2): 157-178 (1997); Lorimer and Pastan Nucleic Acids Res. 23, 3067-8 (1995); Mandecki, Oligonucleotide-directed double-strand break repair in plasmids of *Escherichia coli*: a method for site-specific mutagenesis, Proc. Natl. Acad. Sci. USA, 83:7177-7181(1986); Nakamaye & Eckstein, Inhibition of restriction endonuclease Nci I cleavage by phosphorothioate groups and its application to oligonucleotide-directed mutagenesis, Nucl. Acids Res. 14: 9679-9698 (1986); Nambiar et al., Total synthesis and cloning of a gene coding for the ribonuclease S protein, Science 223: 1299-1301(1984); Sakamar and Khorana, Total synthesis and expression of a gene for the a-subunit of bovine rod outer segment guanine nucleotide-binding protein (transducin), Nucl. Acids Res. 14: 6361-6372 (1988); Sayers et al., Y-T Exonucleases in phosphorothioate-based oligonucleotide-directed mutagenesis, Nucl. Acids Res. 16:791-802 (1988); Sayers et al., Strand specific cleavage of phosphorothioate-containing DNA by reaction with restriction endonucleases in the presence of ethidium bromide, (1988) Nucl. Acids Res. 16: 803-814; Sieber, et al., Nature Biotechnology, 19:456-460 (2001); Smith, In vitro mutagenesis, Ann. Rev. Genet. 19:423-462 (1985); Methods in Enzymol. 100: 468-500 (1983); Methods in Enzymol. 154: 329-350 (1987); Stemmer, Nature 370, 389-91(1994); Taylor et al., The use of phosphorothioate-modified DNA in restriction enzyme reactions to prepare nicked DNA, Nucl. Acids Res. 13: 8749-8764 (1985); Taylor et al., The rapid generation of oligonucleotide-directed mutations at high frequency using phosphorothioate-modified DNA, Nucl. Acids Res. 13: 8765-8787 (1985); Wells et al., Importance of hydrogen-bond formation in stabilizing the transition state of subtilisin, Phil. Trans. R. Soc. Lond. A 317: 415-423 (1986); Wells et al., Cassette mutagenesis: an efficient method for generation of multiple mutations at defined sites, Gene 34:315-323 (1985); Zoller & Smith, Oligonucleotide-directed mutagenesis using M 13-derived vectors: an efficient and general procedure for the production of point mutations in any DNA fragment, Nucleic Acids Res. 10:6487-6500 (1982); Zoller & Smith, Oligonucleotide-directed mutagenesis of DNA fragments cloned into M13 vectors, Methods in Enzymol. 100:468-500 (1983); Zoller & Smith, Oligonucleotide-directed mutagenesis: a simple method using two oligonucleotide primers and a single-stranded DNA template, Methods in Enzymol. 154:329-350 (1987); Clackson et al. (1991) "Making antibody fragments using phage display libraries" Nature 352:624-628; Gibbs et al. (2001) "Degenerate oligonucleotide gene shuffling (DOGS): a method for enhancing the frequency of recombination with family shuffling" Gene 271:13-20; and Hiraga and Arnold (2003) "General method for sequence-independent site-directed chimeragenesis: J. Mol. Biol. 330:287-296. Additional details on many of the above methods can be found in Methods in Enzymology Volume 154, which also describes useful controls for trouble-shooting problems with various mutagenesis methods.

Determining Kinetic Parameters

The polymerases of the invention can be screened or otherwise tested to determine whether the polymerase displays a modified activity for or with a nucleotide analog or template as compared to a parental DNA polymerase (e.g., a corresponding wild-type or available mutant polymerase from which the recombinant polymerase of the invention was derived). For example, branching fraction, a reaction rate constant, $k_{off}$, $k_{cat}$, $K_m$, $V_{max}$, $k_{cat}/K_m$, $V_{max}/K_m$, $k_{pol}$, and/or $K_d$ of the recombinant DNA polymerase for the nucleotide (or analog) or template nucleic acid can be determined. The enzyme perfection metric $k_{cat}/K_m$ is also a useful measure, e.g., for assessing branch rate. $k_{cat}/K_m$ is a measure of substrate binding that leads to product formation (and, thus, includes terms defining binding $K_d$ and inversely predicts branching fraction formation).

As is well-known in the art, for enzymes obeying simple Michaelis-Menten kinetics, kinetic parameters are readily derived from rates of catalysis measured at different substrate concentrations. The Michaelis-Menten equation, $V=V_{max}[S]([S]+K_m)^{-1}$, relates the concentration of uncombined substrate ([S], approximated by the total substrate concentration), the maximal rate ($V_{max}$, attained when the enzyme is saturated with substrate), and the Michaelis constant ($K_m$, equal to the substrate concentration at which the reaction rate is half of its maximal value), to the reaction rate (V).

For many enzymes, $K_m$ is equal to the dissociation constant of the enzyme-substrate complex and is thus a measure of the strength of the enzyme-substrate complex. For such an enzyme, in a comparison of $K_m$s, a lower $K_m$ represents a complex with stronger binding, while a higher Km represents a complex with weaker binding. The ratio $k_{cat}/K_m$, sometimes called the specificity constant, represents the apparent rate constant for combination of substrate with free enzyme. The larger the specificity constant, the more efficient the enzyme is in binding the substrate and converting it to product (this provides an inverse measure of branching rate, as branching rate is the rate at which the enzyme binds substrate (e.g., nucleotide), but does not convert it to product (e.g., a DNA polymer).

$k_{cat}$ (also called the turnover number of the enzyme) can be determined if the total enzyme concentration ([$E_T$], i.e., the concentration of active sites) is known, since $V_{max}=k_{cat}[E_T]$. For situations in which the total enzyme concentration is difficult to measure, the ratio $V_{max}/K_m$ is often used instead as a measure of efficiency. $K_m$ and $V_{max}$ can be determined, for example, from a Lineweaver-Burk plot of 1/V against 1/[S], where the y intercept represents $1/V_{max}$, the x intercept $-1/K_m$, and the slope $K_m/V_{max}$, or from an Eadie-Hofstee plot of V against V/[S], where the y intercept represents $V_{max}$, the x intercept $V_{max}/K_m$, and the slope $-K_m$. Software packages such as KinetAsyst™ or Enzfit (Biosoft, Cambridge, UK) can facilitate the determination of kinetic parameters from catalytic rate data.

For enzymes such as polymerases that have multiple substrates, varying the concentration of only one substrate while holding the others in suitable excess (e.g., effectively constant) concentration typically yields normal Michaelis-Menten kinetics.

Details regarding $k_{off}$ determination are described above. In general, the dissociation rate can be measured in any manner that detects the polymerase/DNA complex over time. This includes stopped-flow spectroscopy, or even simply taking aliquots over time and testing for polymerase activity on the template of interest. Free polymerase is captured with a polymerase trap after dissociation, e.g., by incubation in the presence of heparin or an excess of competitor DNA (e.g., non-specific salmon sperm DNA, or the like).

In one embodiment, using pre-steady-state kinetics, the nucleotide concentration dependence of the rate constant $k_{obs}$ (the observed first-order rate constant for dNTP incorporation) provides an estimate of the $K_m$ for a ground state binding and the maximum rate of polymerization ($k_{pol}$). The $k_{obs}$ is measured using a burst assay. The results of the assay are fitted with the Burst equation; Product=$A[1-\exp(-k_{obs}*t)]+k_{ss}*t$ where A represents amplitude an estimate of the concentration of the enzyme active sites, $k_{ss}$ is the observed steady-state rate constant and t is the reaction incubation time. The $K_m$ for dNTP binding to the polymerase-DNA complex and the $k_{pol}$ are calculated by fitting the dNTP concentration dependent change in the $k_{obs}$ using the equation $k_{obs}=(k_{pol}*[S])*(K_m+[S])-1$ where [S] is the substrate concentration. Results are optionally obtained from a rapid-quench experiment (also called a quench-flow measurement), for example, based on the methods described in Johnson (1986) "Rapid kinetic analysis of mechanochemical adenosinetriphosphatases" Methods Enzymol. 134:677-705, Patel et al. (1991) "Pre-steady-state kinetic analysis of processive DNA replication including complete characterization of an exonuclease-deficient mutant" Biochemistry 30(2):511-25, and Tsai and Johnson (2006) "A new paradigm for DNA polymerase specificity" Biochemistry 45(32):9675-87.

Parameters such as rate of binding of a nucleotide analog or template by the recombinant polymerase, rate of product release by the recombinant polymerase, or branching rate of the recombinant polymerase can also be determined, and optionally compared to that of a parental polymerase (e.g., a corresponding wild-type polymerase).

For a more thorough discussion of enzyme kinetics, see, e.g., Berg, Tymoczko, and Stryer (2002) *Biochemistry, Fifth Edition*, W. H. Freeman; Creighton (1984) *Proteins: Structures and Molecular Principles*, W. H. Freeman; and Fersht (1985) *Enzyme Structure and Mechanism, Second Edition*, W. H. Freeman.

In one aspect, the improved activity of the enzymes of the invention is compared with a given parental polymerase. For example, in the case of enzymes derived from a Φ29 parental enzyme, where the improvement being sought is an increase in stability of the closed complex, an improved enzyme of the invention would have a lower $k_{off}$ than the parental enzyme, e.g., wild type Φ29. Such comparisons are made under equivalent reaction conditions, e.g., equal concentrations of the parental and modified polymerase, equal substrate concentrations, equivalent solution conditions (pH, salt concentration, presence of divalent cations, etc.), temperature, and the like. In one aspect, the improved activity of the enzymes of the invention is measured with reference to a model analog or analog set and compared with a given parental enzyme. Optionally, the improved activity of the enzymes of the invention is measured under specified reaction conditions. While the foregoing may be used as a characterization tool, it in no way is intended as a specifically limiting reaction of the invention.

Optionally, the polymerase also exhibits a $K_m$ for a phosphate-labeled nucleotide analog that is less than a $K_m$ observed for a wild-type polymerase for the analog to facilitate applications in which the polymerase incorporates the analog, e.g., during SMS. For example, the modified recombinant polymerase can exhibit a $K_m$ for the phosphate-labeled nucleotide analog that is less than less than 75%, 50%, 25% or less than that of wild-type or parental polymerase such as a wild type Φ29. In one specific class of examples, the polymerases of the invention have a $K_m$ of about 10 μM or less for a non-natural nucleotide analog such as a phosphate labeled analog.

Determining Whether a Polymerase System Exhibits Two Slow Steps

In some cases the presence of two slow steps can be ascertained by the characteristics of the polymerase reaction run under single molecule sequencing conditions, for example by measuring the distribution of pulse widths. For example, a distribution of pulse widths can be determined using systems described herein where the components of the system are labeled such that a bright state is observed during nucleotide binding, and a dark state is observed from after product release until the next nucleotide binding event. Under these conditions a bright pulse will be observed that corresponds to bound nucleotide. The width of the pulse corresponds to the amount of time that the nucleotide is bound. By measuring the width of a number of pulses, corresponding to a number of nucleotide incorporation events, a distribution of pulse widths can be obtained. From this distribution of pulse widths, in some cases, it can be determined that a polymerase reaction having two slow steps is occurring, and in particular, a polymerase reaction having two slow steps during the bright state during which the nucleotide is associated with the polymerase enzyme. The use of a distribution of pulses to determine a kinetic mechanism having two slow (kinetically observable) steps is described, for example, in Miyake et al. Analytical Chemistry 2008 80 (15), 6018-6022.

Analogously, the presence of two slow steps in the dark phase of a polymerase reaction can in some cases be detected by determining the distribution of the time between pulses (interpulse time). Where the system exhibits two slow steps, a distribution described by a double exponential can be seen.

In some cases, it is not possible or not practical to determine under single molecule conditions whether a system is exhibiting two slow-step kinetics. For example, in some cases, the frame time of the detection optics will be slow enough that a significant number of pulses or interpulse times are not detected, precluding a reliable determination of pulse width or interpulse time distribution. In such cases, the presence of two slow-step kinetics under such polymerase reaction conditions can be determined by running a reaction under substantially the same polymerase reaction conditions, but not under single molecule conditions. For example, a reaction can be run under substantially the same polymerase reaction conditions as the single molecule sequencing system, but with a higher concentration of polymerase enzyme and in some cases, a higher concentration of primer and/or template nucleotide. The reaction run under substantially the same polymerase reaction conditions, but with higher concentrations of polymerase enzyme, primer, and/or template can be used to determine whether the system shows two slow steps as described herein. The reaction to determine two slow-step kinetics may have labels on different components of the reaction than that for single molecule sequencing, such as having labels on the template nucleic acid.

For example, a stopped-flow reaction such as described in the examples below can be used to determine whether the polymerase reaction conditions exhibit two slow steps. As described in the examples, stopped-flow experiments can be used to establish that the polymerase reaction is exhibiting two slow step kinetics either in a bright phase or in a dark phase for single molecule sequencing.

A higher enzyme/primer/template concentration reaction such as a stopped-flow reaction can be used to identify systems having two slow steps for single molecule sequencing. Alternatively, the reaction run under substantially the same conditions but higher concentration of enzyme/primer/template can be used to verify that a single molecule sequencing system is being carried out under polymerase reaction conditions that exhibit two slow steps.

Screening Polymerases

Screening or other protocols can be used to determine whether a polymerase displays a modified activity, e.g., for a nucleotide analog, as compared to a parental DNA polymerase. For example, branching fraction, rate constant, $k_{off}$, $k_{cat}$, $K_m$, $V_{max}$, or $k_{cat}/K_m$ of the recombinant DNA polymerase for the template or nucleotide or analog can be determined as discussed above. As another example, activity can be assayed indirectly, e.g., as described in Example 4. Assays for properties such as protein yield, thermostability, and the like are described herein. Performance of a recombinant polymerase in a sequencing reaction, e.g., a single molecule sequencing reaction, can be examined to assay properties such as speed, pulse width, interpulse distance, accuracy, readlength, etc. as described herein.

In one desirable aspect, a library of recombinant DNA polymerases can be made and screened for these properties. For example, a plurality of members of the library can be made to include one or more mutation that alters (e.g., decreases) reaction rate constants, improves closed complex stability, decreases branching fraction, alters cofactor selectivity, or increases yield, thermostability, accuracy, speed, or readlength and/or randomly generated mutations (e.g., where different members include different mutations or different combinations of mutations), and the library can then be screened for the properties of interest (e.g., decreased rate constant, decreased branching fraction, increased closed complex stability, etc.). In general, the library can be screened to identify at least one member comprising a modified activity of interest.

Libraries of polymerases can be either physical or logical in nature. Moreover, any of a wide variety of library formats can be used. For example, polymerases can be fixed to solid surfaces in arrays of proteins. Similarly, liquid phase arrays of polymerases (e.g., in microwell plates) can be constructed for convenient high-throughput fluid manipulations of solutions comprising polymerases. Liquid, emulsion, or gel-phase libraries of cells that express recombinant polymerases can also be constructed, e.g., in microwell plates, or on agar plates. Phage display libraries of polymerases or polymerase domains (e.g., including the active site region or interdomain stability regions) can be produced. Likewise, yeast display libraries can be used. Instructions in making and using libraries can be found, e.g., in Sambrook, Ausubel and Berger, referenced herein.

For the generation of libraries involving fluid transfer to or from microtiter plates, a fluid handling station is optionally used. Several "off the shelf" fluid handling stations for performing such transfers are commercially available, including e.g., the Zymate systems from Caliper Life Sciences (Hopkinton, Mass.) and other stations which utilize automatic pipettors, e.g., in conjunction with the robotics for plate movement (e.g., the ORCA® robot, which is used in a variety of laboratory systems available, e.g., from Beckman Coulter, Inc. (Fullerton, Calif.).

In an alternate embodiment, fluid handling is performed in microchips, e.g., involving transfer of materials from microwell plates or other wells through microchannels on the chips to destination sites (microchannel regions, wells, chambers or the like). Commercially available microfluidic systems include those from Hewlett-Packard/Agilent Technologies (e.g., the HP2100 bioanalyzer) and the Caliper High Throughput Screening System. The Caliper High Throughput Screening System provides one example interface between standard microwell library formats and Labchip technologies. RainDance Technologies' nanodroplet platform provides another method for handling large numbers of spatially separated reactions. Furthermore, the patent and technical literature includes many examples of microfluidic systems which can interface directly with microwell plates for fluid handling.

Desirable Properties

The polymerases of the invention can include any of a variety of modified properties towards natural nucleotides and/or nucleotide analogs, depending on the application, including decreased branching fraction, increased closed complex stability, increased speed, increased retention time (or decreased speed) for incorporated bases, greater processivity, slower product release, slower isomerization, slower translocation, increased accuracy, increased readlength, etc. For example, $k_{off}$ can be measured to detect closed complex stability, as noted herein. $k_{cat}/K_m$ can be determined as an inverse measure of branch formation. Alternately, branch formation can be directly monitored in high-throughput SMS reactions using known templates. Branch fraction formation or complex stability can be screened for or against in selecting a polymerase of the invention, e.g., by screening enzymes based on kinetic or product formation properties.

For example, improvements in a dissociation rate (or improved processivity) of 30% or more, e.g., about 50%, 75%, or even 100% or more can be screened for in identifying polymerases that display closed complex stability. Similarly, detecting mutant polymerases that form branching fractions of less than 25%, e.g., 10% or less, 5% or less, and even 1% or 0.1% or less is a feature of the invention.

Additional Example Details

A number of specific examples of modified active site and interdomain regions are described herein. An "active site region" is a portion of the polymerase that includes or is proximal to the active site (e.g., within about 2 nm of the active site) in a three dimensional structure of a folded polymerase. Similarly, an interdomain region or residue occurs in the region between two domains, e.g., when the enzyme is in the closed conformation or a closed complex. Specific examples of structural modifications within or proximal to the active site or interdomain regions of Φ29 DNA polymerase are described herein.

A recombinant polymerase optionally further includes one or more mutations relative to the wild-type polymerase that provide additional properties of interest, including deletion or insertion of steric features near the active site that improve specificity for an unnatural nucleotide, or that improve surface bound activity of the protein, or the like. A variety of useful additional mutations that can be used in combination with the present invention are described, e.g., in WO 2007/076057 POLYMERASES FOR NUCLEOTIDE ANALOGUE INCORPORATION by Hanzel et al.; WO 2008/051530 POLYMERASE ENZYMES AND REAGENTS FOR ENHANCED NUCLEIC ACID SEQUENCING by Rank et al.; WO 2007/075987 ACTIVE SURFACE COUPLED POLYMERASES by Hanzel et al.; WO 2007/076057 PROTEIN ENGINEERING STRATEGIES TO OPTIMIZE ACTIVITY OF SURFACE ATTACHED PROTEINS by Hanzel et al.; U.S. patent application Ser. No. 12/584,481 filed Sep. 4, 2009, by Pranav Patel et al. entitled "ENGINEERING POLYMERASES AND REACTION CONDITIONS FOR MODIFIED INCORPORATION PROPERTIES"; and U.S. patent application Ser. No. 12/384,110 filed Mar. 30, 2009, by Keith Bjornson et al. entitled "Enzymes Resistant to Photodamage."

As will be appreciated, the numbering of amino acid residues is with respect to a particular reference polymerase, such as the wild-type sequence of the Φ29 polymerase (SEQ ID NO:1); actual position of a mutation within a molecule of the invention may vary based upon the nature of the various modifications that the enzyme includes relative to the wild type Φ29 enzyme, e.g., deletions and/or additions to the molecule, either at the termini or within the molecule itself.

Tags And Other Optional Polymerase Features

The recombinant DNA polymerase optionally includes additional features exogenous or heterologous to the polymerase. For example, the recombinant polymerase optionally includes one or more tags, e.g., purification, substrate binding, or other tags, such as a polyhistidine tag, a His10 tag, a His6 tag, an alanine tag, an Ala16 tag, an Ala16 tag, a biotin tag, a biotin ligase recognition sequence or other biotin attachment site (e.g., a BiTag or a Btag or variant thereof, e.g., BtagV1-11), a GST tag, an S Tag, a SNAP-tag, an HA tag, a DSB (Sso7D) tag, a lysine tag, a NanoTag, a Cmyc tag, a tag or linker comprising the amino acids glycine and serine, a tag or linker comprising the amino acids glycine, serine, alanine and histidine, a tag or linker comprising the amino acids glycine, arginine, lysine, glutamine and proline, a plurality of polyhistidine tags, a plurality of His10 tags, a plurality of His6 tags, a plurality of alanine tags, a plurality of Ala10 tags, a plurality of Ala16 tags, a plurality of biotin tags, a plurality of GST tags, a plurality of BiTags, a plurality of S Tags, a plurality of SNAP-tags, a plurality of HA tags, a plurality of DSB (Sso7D) tags, a plurality of lysine tags, a plurality of NanoTags, a plurality of Cmyc tags, a plurality of tags or linkers comprising the amino acids glycine and serine, a plurality of tags or linkers comprising the amino acids glycine, serine, alanine and histidine, a plurality of tags or linkers comprising the amino acids glycine, arginine, lysine, glutamine and proline, biotin, avidin, an antibody or antibody domain, antibody fragment, antigen, receptor, receptor domain, receptor fragment, or ligand, one or more protease site (e.g., Factor Xa, enterokinase, or thrombin site), a dye, an acceptor, a quencher, a DNA binding domain (e.g., a helix-hairpin-helix domain from topoisomerase V), or combination thereof. The one or more exogenous or heterologous features at the N- and/or C-terminal regions of the polymerase can find use not only for purification purposes, immobilization of the polymerase to a substrate, and the like, but can also be useful for altering one or more properties of the polymerase.

The one or more exogenous or heterologous features can be included internal to the polymerase, at the N-terminal region of the polymerase, at the C-terminal region of the polymerase, or both the N-terminal and C-terminal regions of the polymerase. Where the polymerase includes an exogenous or heterologous feature at both the N-terminal and C-terminal regions, the exogenous or heterologous features can be the same (e.g., a polyhistidine tag, e.g., a His10 tag, at both the N- and C-terminal regions) or different (e.g., a biotin ligase recognition sequence at the N-terminal region and a polyhistidine tag, e.g., His10 tag, at the C-terminal region). Optionally, a terminal region (e.g., the N- or C-terminal region) of a polymerase of the invention can comprise two or more exogenous or heterologous features which can be the same or different (e.g., a biotin ligase recognition sequence and a polyhistidine tag at the N-terminal region, a biotin ligase recognition sequence, a polyhistidine tag, and a Factor Xa recognition site at the N-terminal region, and the like). As a few examples, the polymerase can include a polyhistidine tag at the C-terminal region, a biotin ligase recognition sequence and a polyhistidine tag at the N-terminal region, a biotin ligase recognition sequence and a polyhistidine tag at the N-terminal region and a polyhistidine tag at the C-terminal region, or a polyhistidine tag and a biotin ligase recognition sequence at the C-terminal region.

Table 10 provides exemplary exogenous features (e.g., tags, linkers, and the like) that are optionally present in polymerases of the invention. As noted above, polymerases of the invention can include any of these features alone or in combination with one or more additional features, typically at the N-terminal and/or C-terminal regions of the polymerase. Note that the initial glycine residue shown for the polyhistidine and polyalanine tags is optional.

TABLE 10

| Feature Name | Amino Acid Sequence |
|---|---|
| GST SEQ ID NO: 7 | MSPILGYWKIKGLVQPTRLLLEYLEEK YEEHLYERDEGDKWRNKKFELGLEFPN LPYYIDGDVKLTQSMAIIRYIADKHNM LGGCPKERAEISMLEGAVLDIRYGVSR IAYSKDFETLKVDFLSKLPEMLKMFED RLCHKTYLNGDHVTHPDFMLYDALDVV LYMDPMCLDAFPKLVCFKKRIEAIPQI DKYLKSSKYIAWPLQGWQATFGGGDHP PK |
| Xa SEQ ID NO: 8 | IEGR |
| Btag SEQ ID NO: 9 | GLNDIFEAQKIEWHE |
| BtagV1 SEQ ID NO: 10 | GLNDLFHAQKIEWHE |
| BtagV2 SEQ ID NO: 11 | GLNDFFNAQKIEWHE |
| BtagV3 SEQ ID NO: 12 | GINDLFSAQKIEWHE |
| BtagV4 SEQ ID NO: 13 | GINDIFEAQKIEWHE |
| BtagV5 SEQ ID NO: 14 | GLNLIFEAQKIEWHE |
| BtagV6 SEQ ID NO: 15 | GLNDLFEAQKIEWHE |
| BtagV7 SEQ ID NO: 16 | GLNDFFEAQKIEWHE |
| BtagV8 SEQ ID NO: 17 | GLNDIVEAQKIEWHE |
| BtagV9 SEQ ID NO: 18 | GLNDIFHAQKIEWHE |
| BtagV10 SEQ ID NO: 19 | GLNDIFNAQKIEWHE |
| BtagV11 SEQ ID NO: 20 | GLNDIFSAQKIEWHE |

TABLE 10-continued

| Feature Name | Amino Acid Sequence |
|---|---|
| NanoTag SEQ ID NO: 21 | DVEAWLGARVPLVET |
| GSGAAAAAAAAAH SEQ ID NO: 22 | GSGAAAAAAAAAH |
| 1942Linker SEQ ID NO: 23 | GGSGGGSGGGSGG |
| Ala10 SEQ ID NO: 24 | AAAAAAAAAA |
| GRKKRRQRRRPPQ SEQ ID NO: 25 | GRKKRRQRRRPPQ |
| Ktag(10) SEQ ID NO: 26 | KKKKKKKKKK |
| GSGAAAAAAAHH SEQ ID NO: 27 | GSGAAAAAAAHH |
| GSGAAAAAAHHH SEQ ID NO: 28 | GSGAAAAAAHHH |
| Cmyc SEQ ID NO: 29 | EQKLISEEDL |
| DSB (Sso7d) SEQ ID NO: 30 | MATVKFKYKGEEKEVDISKIKKVWRVG KMISFTYDEGGGKTGRGAVSEKDAPKE LLQMLEKQKK |
| His6 SEQ ID NO: 31 | GHHHHHH |
| His7 SEQ ID NO: 32 | GHHHHHHH |
| His8 SEQ ID NO: 33 | GHHHHHHHH |
| His9 SEQ ID NO: 34 | GHHHHHHHHH |
| His10 SEQ ID NO: 35 | GHHHHHHHHHH |
| His11 SEQ ID NO: 36 | GHHHHHHHHHHH |
| His12 SEQ ID NO: 37 | GHHHHHHHHHHHH |
| His13 SEQ ID NO: 38 | GHHHHHHHHHHHHH |
| His14 SEQ ID NO: 39 | GHHHHHHHHHHHHHH |
| His15 SEQ ID NO: 40 | GHHHHHHHHHHHHHHH |
| His16 SEQ ID NO: 41 | GHHHHHHHHHHHHHHHH |
| His17 SEQ ID NO: 42 | GHHHHHHHHHHHHHHHHH |
| His18 SEQ ID NO: 43 | GHHHHHHHHHHHHHHHHHH |
| His19 SEQ ID NO: 44 | GHHHHHHHHHHHHHHHHHHH |
| His20 SEQ ID NO: 45 | GHHHHHHHHHHHHHHHHHHHH |
| His21 SEQ ID NO: 46 | GHHHHHHHHHHHHHHHHHHHHH |
| His22 SEQ ID NO: 47 | GHHHHHHHHHHHHHHHHHHHHHH |
| His23 SEQ ID NO: 48 | GHHHHHHHHHHHHHHHHHHHHHHH |
| His24 SEQ ID NO: 49 | GHHHHHHHHHHHHHHHHHHHHHHHH |
| Ala16 SEQ ID NO: 50 | GAAAAAAAAAAAAAAA |

As described in greater detail in U.S. patent application Ser. No. 12/584,481 filed Sep. 4, 2009, by Pranav Patel et al. entitled "ENGINEERING POLYMERASES AND REACTION CONDITIONS FOR MODIFIED INCORPORATION PROPERTIES," fusion of a heterologous sequence at or near the C-terminus of the polymerase can also alter polymerase behavior. For example, fusion of a polyhistidine sequence at the C-terminus can slow translocation, decrease exonuclease activity, and/or increase accuracy. As just one example, a modified Φ29 T368F/E375Y/A484E/K512Y polymerase with a His10 tag (ten histidine polyhistidine tag) fused to its C-terminus (e.g., along with an N-terminal biotin attachment site followed by an N-terminal His10 tag) demonstrates two slow step behavior. That this polymerase (and other polymerases described herein that include one or more heterologous or exogenous features at the C-terminal region) retains its functionality is a surprising aspect of the invention. The active site of the polymerase is located in the C-terminal portion of the protein, and previous attempts to modify the C-terminal portion have rendered the polymerase inactive. See, e.g., Truniger, et al. (2004) "Function of the C-terminus of Φ29 DNA polymerase in DNA and terminal protein binding" Nucleic Acids Research 32(1): 361-370.

The exogenous or heterologous features can find use, e.g., in the context of binding a polymerase in an active form to a surface, e.g., to orient and/or protect the polymerase active site when the polymerase is bound to a surface. In general, surface binding elements and purification tags that can be added to the polymerase (recombinantly or, e.g., chemically) include, e.g., biotin attachment sites (e.g., biotin ligase recognition sequences such as Btags or BiTag), polyhistidine tags, His6 tags, biotin, avidin, GST sequences, modified GST sequences, e.g., that are less likely to form dimers, S tags, SNAP-tags, antibodies or antibody domains, antibody fragments, antigens, receptors, receptor domains, receptor fragments, ligands, or combinations thereof.

One aspect of the invention includes DNA polymerases that can be coupled to a surface without substantial loss of activity (e.g., in an active form). DNA polymerases can be coupled to the surface through a single surface coupling domain or multiple surface coupling domains, which act in concert to increase binding affinity of the polymerase for the surface and to orient the polymerase relative to the surface. For example, the active site can be oriented distal to the surface, thereby making it accessible to a polymerase substrate (template, nucleotides, etc.). This orientation also tends to reduce surface denaturation effects in the region of the active site. In a related aspect, activity of the enzyme can be protected by making the coupling domains large, thereby serving to further insulate the active site from surface binding effects. Further details regarding the immobilization of a polymerase to a surface (e.g., the surface of a zero mode waveguide) in an active form are found in WO 2007/075987 ACTIVE SURFACE COUPLED POLYMERASES by Hanzel et al., and WO 2007/076057 PROTEIN ENGINEERING STRATEGIES TO OPTIMIZE ACTIVITY OF SURFACE ATTACHED PROTEINS by Hanzel et al. Further details on attaching tags is available in the art. See, e.g., U.S. Pat. Nos. 5,723,584 and 5,874,239 for additional information on attaching biotinylation peptides to recombinant proteins.

The polymerase immobilized on a surface in an active form can be coupled to the surface through one or a plurality of artificial or recombinant surface coupling domains as discussed above, and typically displays a $k_{cat}/K_m$ (or $V_{max}/K_m$) that is at least about 1%, at least about 10%, at least about 25%, at least about 50%, or at least about 75% as high as a corresponding active polymerase in solution.

Making and Isolating Recombinant Polymerases

Generally, nucleic acids encoding a polymerase of the invention can be made by cloning, recombination, in vitro synthesis, in vitro amplification and/or other available methods. A variety of recombinant methods can be used for expressing an expression vector that encodes a polymerase of the invention. Methods for making recombinant nucleic acids, expression and isolation of expressed products are well known and described in the art. A number of exemplary mutations and combinations of mutations, as well as strategies for design of desirable mutations, are described herein. Methods for making and selecting mutations in the active site of polymerases, including for modifying steric features in or near the active site to permit improved access by nucleotide analogs are found hereinabove and, e.g., in WO 2007/076057 POLYMERASES FOR NUCLEOTIDE ANALOG INCORPORATION by Hanzel et al. and PCT/US2007/022459 POLYMERASE ENZYMES AND REAGENTS FOR ENHANCED NUCLEIC ACID SEQUENCING by Rank et al.

Additional useful references for mutation, recombinant and in vitro nucleic acid manipulation methods (including cloning, expression, PCR, and the like) include Berger and Kimmel, *Guide to Molecular Cloning Techniques, Methods in Enzymology volume* 152 Academic Press, Inc., San Diego, Calif. (Berger); Kaufman et al. (2003) Handbook of Molecular and Cellular Methods in Biology and Medicine Second Edition Ceske (ed) CRC Press (Kaufman); and *The Nucleic Acid Protocols Handbook* Ralph Rapley (ed) (2000) Cold Spring Harbor, Humana Press Inc (Rapley); Chen et al. (ed) *PCR Cloning Protocols, Second Edition* (Methods in Molecular Biology, volume 192) Humana Press; and in Viljoen et al. (2005)*Molecular Diagnostic PCR Handbook* Springer, ISBN 1402034032.

In addition, a plethora of kits are commercially available for the purification of plasmids or other relevant nucleic acids from cells, (see, e.g., EasyPrep™, FlexiPrep™ both from Pharmacia Biotech; StrataClean™, from Stratagene; and, QIAprep™ from Qiagen). Any isolated and/or purified nucleic acid can be further manipulated to produce other nucleic acids, used to transfect cells, incorporated into related vectors to infect organisms for expression, and/or the like. Typical cloning vectors contain transcription and translation terminators, transcription and translation initiation sequences, and promoters useful for regulation of the expression of the particular target nucleic acid. The vectors optionally comprise generic expression cassettes containing at least one independent terminator sequence, sequences permitting replication of the cassette in eukaryotes, or prokaryotes, or both, (e.g., shuttle vectors) and selection markers for both prokaryotic and eukaryotic systems. Vectors are suitable for replication and integration in prokaryotes, eukaryotes, or both.

Other useful references, e.g. for cell isolation and culture (e.g., for subsequent nucleic acid isolation) include Freshney (1994) *Culture of Animal Cells, a Manual of Basic Technique*, third edition, Wiley-Liss, New York and the references cited therein; Payne et al. (1992) *Plant Cell and Tissue Culture in Liquid Systems* John Wiley & Sons, Inc. New York, N.Y.; Gamborg and Phillips (eds) (1995) *Plant Cell, Tissue and Organ Culture*; Fundamental Methods Springer Lab Manual, Springer-Verlag (Berlin Heidelberg New York) and Atlas and Parks (eds) *The Handbook of Microbiological Media* (1993) CRC Press, Boca Raton, Fla.

Nucleic acids encoding the recombinant polymerases of the invention are also a feature of the invention. A particular amino acid can be encoded by multiple codons, and certain translation systems (e.g., prokaryotic or eukaryotic cells) often exhibit codon bias, e.g., different organisms often prefer one of the several synonymous codons that encode the same amino acid. As such, nucleic acids of the invention are optionally "codon optimized," meaning that the nucleic acids are synthesized to include codons that are preferred by the particular translation system being employed to express the polymerase. For example, when it is desirable to express the polymerase in a bacterial cell (or even a particular strain of bacteria), the nucleic acid can be synthesized to include codons most frequently found in the genome of that bacterial cell, for efficient expression of the polymerase. A similar strategy can be employed when it is desirable to express the polymerase in a eukaryotic cell, e.g., the nucleic acid can include codons preferred by that eukaryotic cell.

A variety of protein isolation and detection methods are known and can be used to isolate polymerases, e.g., from recombinant cultures of cells expressing the recombinant polymerases of the invention. A variety of protein isolation and detection methods are well known in the art, including, e.g., those set forth in R. Scopes, *Protein Purification*, Springer-Verlag, N.Y. (1982); Deutscher, *Methods in Enzymology Vol.* 182: *Guide to Protein Purification*, Academic Press, Inc. N.Y. (1990); Sandana (1997) *Bioseparation of Proteins*, Academic Press, Inc.; Bollag et al. (1996) *Protein Methods, $2^{nd}$ Edition* Wiley-Liss, NY; Walker (1996) *The Protein Protocols Handbook* Humana Press, NJ, Harris and Angal (1990) *Protein Purification Applications: A Practical Approach* IRL Press at Oxford, Oxford, England; Harris and Angal *Protein Purification Methods: A Practical Approach* IRL Press at Oxford, Oxford, England; Scopes (1993) *Protein Purification: Principles and Practice $3^{rd}$ Edition* Springer Verlag, NY; Janson and Ryden (1998) *Protein Purification: Principles, High Resolution Methods and Applications, Second Edition* Wiley-VCH, NY; and Walker (1998) *Protein Protocols on CD-ROM* Humana Press, NJ; and the references cited therein. Additional details regarding protein purification and detection methods can be found in Satinder Ahuja ed., *Handbook of Bioseparations*, Academic Press (2000).

Kits

The present invention also features kits that incorporate the polymerases of the invention, optionally with additional useful reagents such as one or more nucleotide analogs, e.g., for sequencing, nucleic acid amplification, or the like. Such kits can include the polymerase of the invention packaged in a fashion to enable use of the polymerase (e.g., the polymerase immobilized in a ZMW array), a set of different nucleotide analogs of the invention, e.g., those that are analogous to A, T, G, and C, e.g., where one or more of the analogs comprise a detectable moiety, to permit identification in the presence of the analogs. Depending upon the desired application, the kits of the invention optionally include additional reagents, such as natural nucleotides, a control template, and other reagents, such as buffer solutions and/or salt solutions, including, e.g., divalent metal ions such as $Ca^{++}$, $Mg^{++}$, $Mn^{++}$ and/or $Fe^{++}$, and standard solutions, e.g., dye standards for detector calibration. Such kits also typically include instructions for use of the compounds and other reagents in accordance with the desired application methods, e.g., nucleic acid sequencing, amplification and the like.

Nucleic Acid and Polypeptide Sequences and Variants

As described herein, the invention also features polynucleotide sequences encoding, e.g., a polymerase as described herein. Examples of polymerase sequences that include features found herein, e.g., as in Tables 1-9, 13, and 16 are provided. However, one of skill in the art will immediately appreciate that the invention is not limited to the specifically exemplified sequences. For example, one of skill will appreciate that the invention also provides, e.g., many related sequences with the functions described herein, e.g., polynucleotides and polypeptides encoding conservative variants of a polymerase of Tables 1-9, 13, and 16 or any other specifically listed polymerase herein. Combinations of any of the mutations noted herein or combinations of any of the mutations herein in combination with those noted in other available references relating to improved polymerases, such as Hanzel et WO 2007/076057 POLYMERASES FOR NUCLEOTIDE ANALOGUE INCORPORATION; Rank et al. WO 2008/051530 POLYMERASE ENZYMES AND REAGENTS FOR ENHANCED NUCLEIC ACID SEQUENCING; Hanzel et al. WO 2007/075987 ACTIVE SURFACE COUPLED POLYMERASES; Hanzel et al. WO 2007/076057 PROTEIN ENGINEERING STRATEGIES TO OPTIMIZE ACTIVITY OF SURFACE ATTACHED PROTEINS; U.S. patent application Ser. No. 12/584,481 filed Sep. 4, 2009, by Pranav Patel et al. entitled "ENGINEERING POLYMERASES AND REACTION CONDITIONS FOR MODIFIED INCORPORATION PROPERTIES"; and U.S. patent application Ser. No. 12/384,110 filed Mar. 30, 2009, by Keith Bjornson et al. entitled "Enzymes Resistant to Photodamage" are also features of the invention.

Accordingly, the invention provides a variety of polypeptides (polymerases) and polynucleotides (nucleic acids that encode polymerases). Exemplary polynucleotides of the invention include, e.g., any polynucleotide that encodes a polymerase of Tables 1-9, 13, and 16 or otherwise described herein. Because of the degeneracy of the genetic code, many polynucleotides equivalently encode a given polymerase sequence. Similarly, an artificial or recombinant nucleic acid that hybridizes to a polynucleotide indicated above under highly stringent conditions over substantially the entire length of the nucleic acid (and is other than a naturally occurring polynucleotide) is a polynucleotide of the invention. In one embodiment, a composition includes a polypeptide of the invention and an excipient (e.g., buffer, water, pharmaceutically acceptable excipient, etc.). The invention also provides an antibody or antisera specifically immunoreactive with a polypeptide of the invention (e.g., that specifically recognizes a feature of the polymerase that confers decreased branching or increased complex stability.

In certain embodiments, a vector (e.g., a plasmid, a cosmid, a phage, a virus, etc.) comprises a polynucleotide of the invention. In one embodiment, the vector is an expression vector. In another embodiment, the expression vector includes a promoter operably linked to one or more of the polynucleotides of the invention. In another embodiment, a cell comprises a vector that includes a polynucleotide of the invention.

One of skill will also appreciate that many variants of the disclosed sequences are included in the invention. For example, conservative variations of the disclosed sequences that yield a functionally similar sequence are included in the invention. Variants of the nucleic acid polynucleotide sequences, wherein the variants hybridize to at least one disclosed sequence, are considered to be included in the invention. Unique subsequences of the sequences disclosed herein, as determined by, e.g., standard sequence comparison techniques, are also included in the invention.

Conservative Variations

Owing to the degeneracy of the genetic code, "silent substitutions" (i.e., substitutions in a nucleic acid sequence which do not result in an alteration in an encoded polypeptide) are an implied feature of every nucleic acid sequence that encodes an amino acid sequence. Similarly, "conservative amino acid substitutions," where one or a limited number of amino acids in an amino acid sequence are substituted with different amino acids with highly similar properties, are also readily identified as being highly similar to a disclosed construct. Such conservative variations of each disclosed sequence are a feature of the present invention.

"Conservative variations" of a particular nucleic acid sequence refers to those nucleic acids which encode identical or essentially identical amino acid sequences, or, where the nucleic acid does not encode an amino acid sequence, to essentially identical sequences. One of skill will recognize that individual substitutions, deletions or additions which alter, add or delete a single amino acid or a small percentage of amino acids (typically less than 5%, more typically less than 4%, 2% or 1%) in an encoded sequence are "conservatively modified variations" where the alterations result in the deletion of an amino acid, addition of an amino acid, or substitution of an amino acid with a chemically similar amino acid, while retaining the relevant mutational feature (for example, the conservative substitution can be of a residue distal to the active site region, or distal to an interdomain stability region). Thus, "conservative variations" of a listed polypeptide sequence of the present invention include substitutions of a small percentage, typically less than 5%, more typically less than 2% or 1%, of the amino acids of the polypeptide sequence, with an amino acid of the same conservative substitution group. Finally, the addition of sequences which do not alter the encoded activity of a nucleic acid molecule, such as the addition of a non-functional or tagging sequence (introns in the nucleic acid, poly His or similar sequences in the encoded polypeptide, etc.), is a conservative variation of the basic nucleic acid or polypeptide.

Conservative substitution tables providing functionally similar amino acids are well known in the art, where one amino acid residue is substituted for another amino acid residue having similar chemical properties (e.g., aromatic side chains or positively charged side chains), and therefore does not substantially change the functional properties of the polypeptide molecule. The following sets forth example groups that contain natural amino acids of like chemical properties, where substitutions within a group is a "conservative substitution".

TABLE 11

Conservative amino acid substitutions

| Nonpolar and/or Aliphatic Side Chains | Polar, Uncharged Side Chains | Aromatic Side Chains | Positively Charged Side Chains | Negatively Charged Side Chains |
|---|---|---|---|---|
| Glycine Alanine Valine Leucine Isoleucine Proline | Serine Threonine Cysteine Methionine Asparagine Glutamine | Phenylalanine Tyrosine Tryptophan | Lysine Arginine Histidine | Aspartate Glutamate |

Nucleic Acid Hybridization

Comparative hybridization can be used to identify nucleic acids of the invention, including conservative variations of nucleic acids of the invention. In addition, target nucleic acids which hybridize to a nucleic acid of the invention under high, ultra-high and ultra-ultra high stringency conditions, where the nucleic acids encode mutants corresponding to those noted in Tables 1-9, 13, and 16 or other listed polymerases, are a feature of the invention. Examples of such nucleic acids include those with one or a few silent or conservative nucleic acid substitutions as compared to a given nucleic acid sequence encoding a polymerase of Tables 1-9, 13, and 16 (or other exemplified polymerase), where any conservative substitutions are for residues other than those noted in Tables 1-9, 13, and 16 or elsewhere as being relevant to a feature of interest (improved closed complex stability, decreased branch fraction formation, etc.).

A test nucleic acid is said to specifically hybridize to a probe nucleic acid when it hybridizes at least 50% as well to the probe as to the perfectly matched complementary target, i.e., with a signal to noise ratio at least half as high as hybridization of the probe to the target under conditions in which the perfectly matched probe binds to the perfectly matched complementary target with a signal to noise ratio that is at least about 5×-10× as high as that observed for hybridization to any of the unmatched target nucleic acids.

Nucleic acids "hybridize" when they associate, typically in solution. Nucleic acids hybridize due to a variety of well characterized physico-chemical forces, such as hydrogen bonding, solvent exclusion, base stacking and the like. An extensive guide to the hybridization of nucleic acids is found in Tijssen (1993) *Laboratory Techniques in Biochemistry and Molecular Biology—Hybridization with Nucleic Acid Probes* part I chapter 2, "Overview of principles of hybridization and the strategy of nucleic acid probe assays," (Elsevier, N.Y.), as well as in *Current Protocols in Molecular Biology*, Ausubel et al., eds., *Current Protocols*, a joint venture between Greene Publishing Associates, Inc. and John Wiley & Sons, Inc., (supplemented through 2011); Hames and Higgins (1995) *Gene Probes* 1 IRL Press at Oxford University Press, Oxford, England, (Hames and Higgins 1) and Hames and Higgins (1995) *Gene Probes* 2 IRL Press at Oxford University Press, Oxford, England (Hames and Higgins 2) provide details on the synthesis, labeling, detection and quantification of DNA and RNA, including oligonucleotides.

An example of stringent hybridization conditions for hybridization of complementary nucleic acids which have more than 100 complementary residues on a filter in a Southern or northern blot is 50% formalin with 1 mg of heparin at 42° C., with the hybridization being carried out overnight. An example of stringent wash conditions is a 0.2×SSC wash at 65° C. for 15 minutes (see, Sambrook, supra for a description of SSC buffer). Often the high stringency wash is preceded by a low stringency wash to remove background probe signal. An example low stringency wash is 2×SSC at 40° C. for 15 minutes. In general, a signal to noise ratio of 5× (or higher) than that observed for an unrelated probe in the particular hybridization assay indicates detection of a specific hybridization.

"Stringent hybridization wash conditions" in the context of nucleic acid hybridization experiments such as Southern and northern hybridizations are sequence dependent, and are different under different environmental parameters. An extensive guide to the hybridization of nucleic acids is found in Tijssen (1993), supra. and in Hames and Higgins, 1 and 2. Stringent hybridization and wash conditions can easily be determined empirically for any test nucleic acid. For example, in determining stringent hybridization and wash conditions, the hybridization and wash conditions are gradually increased (e.g., by increasing temperature, decreasing salt concentration, increasing detergent concentration and/or increasing the concentration of organic solvents such as formalin in the hybridization or wash), until a selected set of criteria are met. For example, in highly stringent hybridization and wash conditions, the hybridization and wash conditions are gradually increased until a probe binds to a perfectly matched complementary target with a signal to noise ratio that is at least 5× as high as that observed for hybridization of the probe to an unmatched target.

"Very stringent" conditions are selected to be equal to the thermal melting point ($T_m$) for a particular probe. The $T_m$ is the temperature (under defined ionic strength and pH) at which 50% of the test sequence hybridizes to a perfectly matched probe. For the purposes of the present invention, generally, "highly stringent" hybridization and wash conditions are selected to be about 5° C. lower than the $T_m$ for the specific sequence at a defined ionic strength and pH.

"Ultra high-stringency" hybridization and wash conditions are those in which the stringency of hybridization and wash conditions are increased until the signal to noise ratio for binding of the probe to the perfectly matched complementary target nucleic acid is at least 10× as high as that observed for hybridization to any of the unmatched target nucleic acids. A target nucleic acid which hybridizes to a probe under such conditions, with a signal to noise ratio of at least ½ that of the perfectly matched complementary target nucleic acid is said to bind to the probe under ultra-high stringency conditions.

Similarly, even higher levels of stringency can be determined by gradually increasing the hybridization and/or wash conditions of the relevant hybridization assay. For example, those in which the stringency of hybridization and wash conditions are increased until the signal to noise ratio for binding of the probe to the perfectly matched complementary target nucleic acid is at least 10×, 20×, 50×, 100×, or 500× or more as high as that observed for hybridization to any of the unmatched target nucleic acids. A target nucleic acid which hybridizes to a probe under such conditions, with a signal to noise ratio of at least ½ that of the perfectly matched complementary target nucleic acid is said to bind to the probe under ultra-ultra-high stringency conditions.

Nucleic acids that do not hybridize to each other under stringent conditions are still substantially identical if the polypeptides which they encode are substantially identical. This occurs, e.g., when a copy of a nucleic acid is created using the maximum codon degeneracy permitted by the genetic code.

Unique Subsequences

In some aspects, the invention provides a nucleic acid that comprises a unique subsequence in a nucleic acid that encodes a polymerase of Tables 1-9, 13, and 16 or others described herein. The unique subsequence may be unique as compared to a nucleic acid corresponding to, e.g., a wild type Φ29-type polymerase. Alignment can be performed using, e.g., BLAST set to default parameters. Any unique subsequence is useful, e.g., as a probe to identify the nucleic acids of the invention.

Similarly, the invention includes a polypeptide which comprises a unique subsequence in a polymerase of Tables 1-9, 13, and 16 or otherwise detailed herein. Here, the unique subsequence is unique as compared to, e.g., a wild type Φ29-type polymerase or previously characterized mutation thereof.

The invention also provides for target nucleic acids which hybridize under stringent conditions to a unique coding oligonucleotide which encodes a unique subsequence in a polypeptide selected from the modified polymerase sequences of the invention, wherein the unique subsequence is unique as compared to a polypeptide corresponding to wild type Φ29. Unique sequences are determined as noted above.

Sequence Comparison, Identity, and Homology

The terms "identical" or "percent identity," in the context of two or more nucleic acid or polypeptide sequences, refer to two or more sequences or subsequences that are the same or have a specified percentage of amino acid residues or nucleotides that are the same, when compared and aligned for maximum correspondence, as measured using one of the sequence comparison algorithms described below (or other algorithms available to persons of skill) or by visual inspection.

The phrase "substantially identical," in the context of two nucleic acids or polypeptides (e.g., DNAs encoding a polymerase, or the amino acid sequence of a polymerase) refers to two or more sequences or subsequences that have at least about 60%, about 80%, about 90-95%, about 98%, about 99% or more nucleotide or amino acid residue identity, when compared and aligned for maximum correspondence, as measured using a sequence comparison algorithm or by visual inspection. Such "substantially identical" sequences are typically considered to be "homologous," without reference to actual ancestry. Preferably, the "substantial identity" exists over a region of the sequences that is at least about 50 residues in length, more preferably over a region of at least about 100 residues, and most preferably, the sequences are substantially identical over at least about 150 residues, or over the full length of the two sequences to be compared.

Proteins and/or protein sequences are "homologous" when they are derived, naturally or artificially, from a common ancestral protein or protein sequence. Similarly, nucleic acids and/or nucleic acid sequences are homologous when they are derived, naturally or artificially, from a common ancestral nucleic acid or nucleic acid sequence. Homology is generally inferred from sequence similarity between two or more nucleic acids or proteins (or sequences thereof). The precise percentage of similarity between sequences that is useful in establishing homology varies with the nucleic acid and protein at issue, but as little as 25% sequence similarity over 50, 100, 150 or more residues is routinely used to establish homology. Higher levels of sequence similarity, e.g., 30%, 40%, 50%, 60%, 70%, 80%, 90%, 95%, or 99% or more identity, can also be used to establish homology. Methods for determining sequence similarity percentages (e.g., BLASTP and BLASTN using default parameters) are described herein and are generally available.

For sequence comparison and homology determination, typically one sequence acts as a reference sequence to which test sequences are compared. When using a sequence comparison algorithm, test and reference sequences are input into a computer, subsequence coordinates are designated, if necessary, and sequence algorithm program parameters are designated. The sequence comparison algorithm then calculates the percent sequence identity for the test sequence(s) relative to the reference sequence, based on the designated program parameters.

Optimal alignment of sequences for comparison can be conducted, e.g., by the local homology algorithm of Smith & Waterman, Adv. Appl. Math. 2:482 (1981), by the homology alignment algorithm of Needleman & Wunsch, J. Mol. Biol. 48:443 (1970), by the search for similarity method of Pearson & Lipman, Proc. Nat'l. Acad. Sci. USA 85:2444 (1988), by computerized implementations of these algorithms (GAP, BESTFIT, FASTA, and TFASTA in the Wisconsin Genetics Software Package, Genetics Computer Group, 575 Science Dr., Madison, Wis.), or by visual inspection (see generally *Current Protocols in Molecular Biology*, Ausubel et al., eds., *Current Protocols*, a joint venture between Greene Publishing Associates, Inc. and John Wiley & Sons, Inc., supplemented through 2011).

One example of an algorithm that is suitable for determining percent sequence identity and sequence similarity is the BLAST algorithm, which is described in Altschul et al., J. Mol. Biol. 215:403-410 (1990). Software for performing BLAST analyses is publicly available through the National Center for Biotechnology Information. This algorithm involves first identifying high scoring sequence pairs (HSPs) by identifying short words of length W in the query sequence, which either match or satisfy some positive-valued threshold score T when aligned with a word of the same length in a database sequence. T is referred to as the neighborhood word score threshold (Altschul et al., supra). These initial neighborhood word hits act as seeds for initiating searches to find longer HSPs containing them. The word hits are then extended in both directions along each sequence for as far as the cumulative alignment score can be increased. Cumulative scores are calculated using, for nucleotide sequences, the parameters M (reward score for a pair of matching residues; always >0) and N (penalty score for mismatching residues; always <0). For amino acid sequences, a scoring matrix is used to calculate the cumulative score. Extension of the word hits in each direction are halted when: the cumulative alignment score falls off by the quantity X from its maximum achieved value; the cumulative score goes to zero or below, due to the accumulation of one or more negative-scoring residue alignments; or the end of either sequence is reached. The BLAST algorithm parameters W, T, and X determine the sensitivity and speed of the alignment. The BLASTN program (for nucleotide sequences) uses as defaults a wordlength (W) of 11, an expectation (E) of 10, a cutoff of 100, M=5, N=−4, and a comparison of both strands. For amino acid sequences, the BLASTP program uses as defaults a wordlength (W) of 3, an expectation (E) of 10, and the BLOSUM62 scoring matrix (see Henikoff & Henikoff (1989) Proc. Natl. Acad. Sci. USA 89:10915).

In addition to calculating percent sequence identity, the BLAST algorithm also performs a statistical analysis of the similarity between two sequences (see, e.g., Karlin & Altschul (1993) Proc. Nat'l. Acad. Sci. USA 90:5873-5787). One measure of similarity provided by the BLAST algorithm is the smallest sum probability (P(N)), which provides an indication of the probability by which a match between two nucleotide or amino acid sequences would occur by chance. For example, a nucleic acid is considered similar to a reference sequence if the smallest sum probability in a comparison of the test nucleic acid to the reference nucleic acid is less than about 0.1, more preferably less than about 0.01, and most preferably less than about 0.001.

For reference, the amino acid sequence of a wild-type Φ29 polymerase is presented in Table 12, along with the sequences of several other wild-type Φ29-type polymerases.

For reference, the amino acid sequence of a wild-type Φ29 polymerase is presented in Table 12, along with the sequences of several other wild-type Φ29-type polymerases.

TABLE 12

Amino acid sequence of exemplary wild-type Φ29-type polymerases.

| | |
|---|---|
| Φ29 SEQ ID NO: 1 | MKHMPRKMYSCDFETTTKVEDCRVWAYGYMNIEDHSEYKIGNSLDEFMA WVLKVQADLYFHNLKFDGAFIINWLERNGFKWSADGLPNTYNTIISRMGQW YMIDICLGYKGKRKIHTVIYDSLKKLPFPVKKIAKDFKLTVLKGDIDYHKERPV GYKITPEEYAYIKNDIQIIAEALLIQFKQGLDRMTAGSDSLKGFKDIITTKKFKK VFPTLSLGLDKEVRYAYRGGFTWLNDRFKEKEIGEGMVFDVNSLYPAQMY SRLLPYGEPIVFEGKYVWDEDYPLHIQHIRCEFELKEGYIPTIQIKRSRFYKG NEYLKSSGGEIADLWLSNVDLELMKEHYDLYNVEYISGLKFKATTGLFKDFI |

TABLE 12-continued

Amino acid sequence of exemplary wild-type Φ29-type polymerases.

|  |  |
|---|---|
|  | DKWTYIKTTSEGAIKQLAKLMLNSLYGKFASNPDVTGKVPYLKENGALGFR<br>LGEEETKDPVYTPMGVFITAWARYTTITAAQACYDRIIYCDTDSIHLTGTEIP<br>DVIKDIVDPKKLGYWAHESTFKRAKYLRQKTYIQDIYMKEVDGKLVEGSPD<br>DYTDIKFSVKCAGMTDKIKKEVTFENFKVGFSRKMKPKPVQVPGGVVLVD<br>DTFTIK |
| M2Y<br>SEQ ID NO: 2 | MSRKMFSCDFETTTKLDDCRVWAYGYMEIGNLDNYKIGNSLDEFMQWVM<br>EIQADLYFHNLKFDGAFIVNWLEQHGFKWSNEGLPNTYNTIISKMGQWYMI<br>DICFGYKGKRKLHTVIYDSLKKLPFPVKKIAKDFQLPLLKGDIDYHTERPVGH<br>EITPEEYEYIKNDIEIIARALDIQFKQGLDRMTAGSDSLKGFKDILSTKKFNKV<br>FPKLSLPMDKEIRKAYRGGFTWLNDKYKEKEIGEGMVFDVNSLYPSQMYS<br>RPLPYGAPIVFQGKYEKDEQYPLYIQRIRFEFELKEGYIPTIQIKKNPFFKGN<br>EYLKNSGVEPVELYLTNVDLELIQEHYELYNVEYIDGFKFREKTGLFKDFIDK<br>WTYVKTHEEGAKKQLAKLMLNSLYGKFASNPDVTGKVPYLKDDGSLGFRV<br>GDEEYKDPVYTPMGVFITAWARFTTITAAQACYDRIIYCDTDSIHLTGTEVP<br>EIIKDIVDPKKLGYWAHESTFKRAKYLRQKTYIQDIYVKEVDGKLKECSPDE<br>ATTTKFSVKCAGMTDTIKKKVTFDNFAVGFSSMGKPKPVQVNGGVVLVDS<br>VFTIK |
| B103<br>SEQ ID NO: 3 | MPRKMFSCDFETTTKLDDCRVWAYGYMEIGNLDNYKIGNSLDEFMQWVM<br>EIQADLYFHNLKFDGAFIVNWLEHHGFKWSNEGLPNTYNTIISKMGQWYMI<br>DICFGYKGKRKLHTVIYDSLKKLPFPVKKIAKDFQLPLLKGDIDYHAERPVG<br>HEITPEEYEYIKNDIEIIARALDIQFKQGLDRMTAGSDSLKGFKDILSTKKFNK<br>VFPKLSLPMDKEIRRAYRGGFTWLNDKYKEKEIGEGMVFDVNSLYPSQMY<br>SRPLPYGAPIVFQGKYEKDEQYPLYIQRIRFEFELKEGYIPTIQIKKNPFFKG<br>NEYLKNSGAEPVELYLTNVDLELIQEHYEMYNVEYIDGFKFREKTGLFKEFI<br>DKWTYVKTHEKGAKKQLAKLMFDSLYGKFASNPDVTGKVPYLKEDGSLGF<br>RVGDEEYKDPVYTPMGVFITAWARFTTITAAQACYDRIIYCDTDSIHLTGTE<br>VPEIIKDIVDPKKLGYWAHESTFKRAKYLRQKTYIQDIYAKEVDGKLIECSPD<br>EATTTKFSVKCAGMTDTIKKKVTFDNFRVGFSSTGKPKPVQVNGGVVLVD<br>SVFTIK |
| GA-1<br>SEQ ID NO: 4 | MARSVYVCDFETTTDPEDCRLWAWGWMDIYNTDKWSYGEDIDSFMEWA<br>LNSNSDIYFHNLKFDGSFILPWWLRNGYVHTEEDRTNTPKEFTTTISGMGQ<br>WYAVDVCINTRGKNKNHVVFYDSLKKLPFKVEQIAKGFGLPVLKGDIDYKK<br>YRPVGYVMDDNEIEYLKHDLLIVALALRSMFDNDFTSMTVGSDALNTYKEM<br>LGVKQWEKYFPVLSLKVNSEIRKAYKGGFTWVNPKYQGETVYGGMVFDV<br>NSMYPAMMKNKLLPYGEPVMFKGEYKKNVEYPLYIQQVRCFFELKKDKIP<br>CIQIKGNARFGQNEYLSTSGDEYVDLYVTNVDWELIKKHYDIFEEEFIGGFM<br>FKGFIGFFDEYIDRFMEIKNSPDSSAEQSLQAKLMLNSLYGKFATNPDITGK<br>VPYLDENGVLKFRKGELKERDPVYTPMGCFITAYARENILSNAQKLYPRFIY<br>ADTDSIHVEGLGEVDAIKDVIDPKKLGYWDHEATFQRARYVRQKTYFIETT<br>WKENDKGKLVVCEPQDATKVKPKIACAGMSDAIKERIRFNEFKIGYSTHGS<br>LKPKNVLGGVVLMDYPFAIK |
| AV-1<br>SEQ ID NO: 5 | MVRQSTIASPARGGVRRSHKKVPSFCADFETTTDEDDCRVWSWGIIQVGK<br>LQNYVDGISLDGFMSHISERASHIYFHNLAFDGTFILDWLLKHGYRWTKEN<br>PGVKEFTSLISRMGKYYSITVVFETGFRVEFRDSPKKLPMSVSAIAKAFNLH<br>DQKLEIDYEKPRPIGYIPTEQEKRYQRNDVAIVAQALEVQFAEKMTKLTAGS<br>DSLATYKKMTGKLFIRRFPILSPEIDTEIRKAYRGGFTYADPRYAKKLNGKG<br>SVYDVNSLYPSVMRTALLPYGEPIYSEGAPRTNRPLYIASITFTAKLKPNHIP<br>CIQIKKNLSFNPTQYLEEVKEPTTVVATNIDIELWKKHYDFKIYSWNGTFEFR<br>GSHGFFDTYVDHFMEIKKNSTGGLRQIAKLHLNSLYGKFATNPDITGKHPTL<br>KDNRVSLVMNEPETRDPVYTPMGVFITAYARKKTISAAQDNYETFAYADTD<br>SLHLIGPTTPPDSLWVDPVELGAWKHESSFTKSVYIRAKQYAEEIGGKLDV<br>HIAGMPRNVAATLTLEDMLHGGTWNGKLIPVRVPGGTVLKDTTFTLKID |
| CP-1<br>SEQ ID NO: 6 | MTCYYAGDFETTTNEEETEVWLSCFAKVIDYDKLDTFKVNTSLEDFLKSLY<br>LDLDKTYTETGEDEFIIFFHNLKFDGSFLLSFFLNNDIECTYFINDMGVWYSI<br>TLEFPDFTLTFRDSLKILNFSIATMAGLFKMPIAKGTTPLLKHKPEVIKPEWID<br>YIHVDVAILARGIFAMYYEENFTKYTSASEALTEFKRIFRKSKRKFRDFFPILD<br>EKVDDFCRKHIVGAGRLPTLKHRGRTLNQLIDIYDINSMYPATMLQNALPIGI<br>PKRYKGKPKEIKEDHYYIYHIKADFDLKRGYLPTIQIKKKLDALRIGVRTSDY<br>VTTSKNEVIDLYLTNFDLDLFLKHYDATIMYVETLEFQTESDLFDDYITTYRY<br>KKENAQSPAEKQKAKIMLNSLYGKFGAKIISVKKLAYLDDKGILRFKNDDEE<br>EVQPVYAPVALFVTSIARHFIISNAQENYDNFLYADTDSLHLFHSDSLVLDID<br>PSEFGKWAHEGRAVKAKYLRSKLYIEELIQEDGTTHLDVKGAGMTPEIKEKI<br>TFENFVIGATFEGKRASKQIKGGTLIYETTFKIRETDYLV |

Exemplary Mutation Combinations

A list of exemplary polymerase mutation combinations, and optional corresponding exogenous or heterologous features at the N- and/or C-terminal region of the polymerase, is provided in Table 13. Positions of amino acid substitutions and/or insertions are identified relative to a wild-type Φ29 DNA polymerase (SEQ ID NO:1). Polymerases of the invention (including those provided in Table 13) can include any exogenous or heterologous feature (or combination of such features) at the N- and/or C-terminal region. For example, it will be understood that polymerase mutants in Table 13 that do not include, e.g., a C-terminal polyhistidine tag can be modified to include a polyhistidine tag at the C-terminal region, alone or in combination with any of the exogenous or heterologous features described herein. Similarly, some or all of the exogenous features listed in Table 13 can be omitted and still result in a polymerase of the invention. Certain features are followed by "co", meaning that the codon encoding that amino acid is optimized for expression in a bacterial cell.

As will be appreciated, "mutations" with respect to Table 13 and any of the polymerases provided herein can comprise one or more amino acid substitutions, deletions, insertions, and the like. Accordingly, certain mutation combinations provided in Table 13 and elsewhere herein include one or more amino acid insertions. For example, "511.1K 511.2S" indicates the insertion of a lysine residue and a serine residue between positions 511 and 512 relative to a wild-type Φ29 DNA polymerase (SEQ ID NO:1), where the lysine immediately follows position 511 and the serine immediately follows the inserted lysine, etc.

TABLE 13

| N-terminal region feature(s) | Mutations | C-terminal region feature(s) |
| --- | --- | --- |
| Btag-His10-Xa | N62D E375Y K512Y | |
| Btag-His10-Xa | N62D T368F E375Y K512Y | |
| Btag.co-His10.co-Xa.co | N62D T368F E375Y K512Y | |
| Btag.co-His10.co-Xa.co. | T368F E375Y K512Y | |
| Btagco-His10co. | N62D L253A E375Y A484E K512Y | |
| Btagco-His10co. | N62D L253A E375Y K512Y | |
| Btag-His10. | N62D T368F E375Y A484E K512Y.co | His10 |
| Btag-His10-Xa. | N62D T368F E375Y A484E K512Y | |
| Btagco.His10co. | N62D L253A E375Y A484E K512Y.co | His10 |
| Btagco.His10co. | N62D L253A E375Y A484E K512Y.co | 1942Linkco_Ala10co |
| Btagco.His10co | N62D H149M T368F E375Y D510M K512Y D523M.co | |
| Btagco.His10co | N62H E375Y A484E E508R K512Y.co | His10 |
| Btagco.His10co | D12R N62H T368F E375Y A484E K512Y.co | His10 |
| Btagco.His10co | D12R T368F E375Y A484E E508R 511.1K 511.2S 512.1G 512.2S.co | His10 |
| Btagco.His10co | D12R T368F E375Y I378W A484E E508R 511.1K 511.2S 512.1G 512.2S.co | His10 |
| Btagco.His10co | Y148A E375Y A484E K512Y.co | |
| Btagco.His10co. | N62D A190E E375Y K422A A484E E508R K512Y.co | |
| Btagco.His10co. | N62D I93Y T368F T372Y E375Y I378W K478Y A484E E508R 511.1K 511.2S K512Y 512.1G 512.2S.co | His10 |
| Btagco-His10co. | N62D T368F E375Y P477Q A484E K512Y | |
| Btagco.His10co. | N62D T368F E375Y L384M A484E K512Y.co | |
| Btag.co-His10.co-Xa.co. | T368F E375Y P477E K512Y | |
| Btagco-His10co. | A176V T368F E375Y K512Y | |
| Btagco.His10co. | T368F E375Y K422R K512Y | |
| Btagco.His10co. | N62D E375Y P477Q A484E K512Y.co | |
| Btag.co-His10.co-Xa.co. | I93F T368F E375Y A484E K512Y | |
| Btagco.His10co. | L253A E375Y A484E K512Y.co | |
| Btagco.His10co. | N62D L253A E375Y E420M A484E K512Y.co | |
| Btagco.His10co. | N62D L253A E375Y K422A A484E K512Y.co | |
| Btagco.His10co. | N62D L253A E375Y A484E E508K K512Y.co | |
| Btagco.His10co. | N62D S215D L253A E375Y A484E K512Y.co | |
| Btagco.His10co. | N62D L253T E375Y A484E K512Y.co | |
| Btagco.His10co. | N62D L253A Y369H E375Y A484E K512Y.co | |
| Btagco.His10co. | N62D L253A Y369G E375Y A484E K512Y.co | |
| Btagco.His10co. | N62D L253A Y369L E375Y A484E K512Y.co | |
| Btagco.His10co. | N62D L253A E375F A484E K512Y.co | |
| Btagco.His10co. | D66R L253A E375Y A484E K512Y.co | |
| Btagco.His10co. | N62D L253A E375Y A484E I504R K512Y.co | |
| Btagco.His10co. | N62D L253A E375Y A484E D510K K512Y.co | |
| Btagco.His10co. | L253A_E375Y_A484E_K512Y.co | His10co |
| BtagV7co.His10co. | L253A_E375Y_A484E_K512Y.co | His10co |
| Btagco.His10co. | L253A E375Y A484E E508R K512Y.co | His10co |

The amino acid sequences of recombinant Φ29 polymerases harboring the exemplary mutation combinations of Table 13 are provided in Tables 14 and 15. Table 14 includes the polymerase portion of the molecule as well as the one or more exogenous features at the N- and/or C-terminal region of the polymerase, while Table 15 includes the amino acid sequence of the polymerase portion only.

TABLE 14

| SEQ ID NO | Amino Acid Sequence |
| --- | --- |
| 51 phi29co.Btag-His10-Xa.N62D_E375Y_K512Y. | MSVDGLNDIFEAQKIEWHEAMGHHHHHHHHHHSSG HIEGRHMKHMPRKMYSCDFETTTKVEDCRVWAYG YMNIEDHSEYKIGNSLDEFMAWVLKVQADLYFHDL KFDGAFIINWLERNGFKWSADGLPNTYNTIISRMGQ WYMIDICLGYKGKRKIHTVIYDSLKKLPFPVKKIAKD FKLTVLKGDIDYHKERPVGYKITPEEYAYIKNDIQIIA EALLIQFKQGLDRMTAGSDSLKGFKDIITTKKFKKVF PTLSLGLDKEVRYAYRGGFTWLNDRFKEKEIGEGMV FDVNSLYPAQMYSRLLPYGEPIVFEGKYVWDEDYPL HIQHIRCEFELKEGYIPTIQIKRSRF YKGNEYLKSSGGEIADLWLSNVDLELMKEHYDLYN VEYISGLKFKATTGLFKDFIDKWTYIKTTSYGAIKQL AKLMLNSLYGKFASNPDVTGKVPYLKENGALGFRL GEEETKDPVYTPMGVFITAWARYTTITAAQACYDRII YCDTDSIHLTGTEIPDVIKDIVDPKKLGYWAHESTFK RAKYLRQKTYIQDIYMKEVDGYLVEGSPDDYTDIKF SVKCAGMTDKIKKEVTFENFKVGFSRKMKPKPVQVP GGVVLVDDTFTIK |
| 52 phi29co.Btag-His10-Xa.N62D_T368F_E375Y_K512Y. | MSVDGLNDIFEAQKIEWHEAMGHHHHHHHHHHSSG HIEGRHMKHMPRKMYSCDFETTTKVEDCRVWAYG YMNIEDHSEYKIGNSLDEFMAWVLKVQADLYFHDL KFDGAFIINWLERNGFKWSADGLPNTYNTIISRMGQ WYMIDICLGYKGKRKIHTVIYDSLKKLPFPVKKIAKD FKLTVLKGDIDYHKERPVGYKITPEEYAYIKNDIQIIA EALLIQFKQGLDRMTAGSDSLKGFKDIITTKKFKKVF PTLSLGLDKEVRYAYRGGFTWLNDRFKEKEIGEGMV FDVNSLYPAQMYSRLLPYGEPIVFEGKYVWDEDYPL HIQHIRCEFELKEGYIPTIQIKRSRF YKGNEYLKSSGGEIADLWLSNVDLELMKEHYDLYN VEYISGLKFKATTGLFKDFIDKWFYIKTTSYGAIKQL AKLMLNSLYGKFASNPDVTGKVPYLKENGALGFRL GEEETKDPVYTPMGVFITAWARYTTITAAQACYDRII YCDTDSIHLTGTEIPDVIKDIVDPKKLGYWAHESTFK RAKYLRQKTYIQDIYMKEVDGYLVEGSPDDYTDIKF SVKCAGMTDKIKKEVTFENFKVGFSRKMKPKPVQVP GGVVLVDDTFTIK |
| 53 phi29co.Btagco-His10co-Xaco.N62D_T368F_E375Y_K512Y. | MSVDGLNDIFEAQKIEWHEAMGHHHHHHHHHHSSG HIEGRHMKHMPRKMYSCDFETTTKVEDCRVWAYG YMNIEDHSEYKIGNSLDEFMAWVLKVQADLYFHDL KFDGAFIINWLERNGFKWSADGLPNTYNTIISRMGQ WYMIDICLGYKGKRKIHTVIYDSLKKLPFPVKKIAKD FKLTVLKGDIDYHKERPVGYKITPEEYAYIKNDIQIIA EALLIQFKQGLDRMTAGSDSLKGFKDIITTKKFKKVF PTLSLGLDKEVRYAYRGGFTWLNDRFKEKEIGEGMV FDVNSLYPAQMYSRLLPYGEPIVFEGKYVWDEDYPL HIQHIRCEFELKEGYIPTIQIKRSRF YKGNEYLKSSGGEIADLWLSNVDLELMKEHYDLYN VEYISGLKFKATTGLFKDFIDKWFYIKTTSYGAIKQL AKLMLNSLYGKFASNPDVTGKVPYLKENGALGFRL GEEETKDPVYTPMGVFITAWARYTTITAAQACYDRII YCDTDSIHLTGTEIPDVIKDIVDPKKLGYWAHESTFK RAKYLRQKTYIQDIYMKEVDGYLVEGSPDDYTDIKF SVKCAGMTDKIKKEVTFENFKVGFSRKMKPKPVQVP GGVVLVDDTFTIK |
| 54 phi29co.Btagco-His10co-Xaco.T368F_E375Y_K512Y. | MSVDGLNDIFEAQKIEWHEAMGHHHHHHHHHHSSG HIEGRHMKHMPRKMYSCDFETTTKVEDCRVWAYG YMNIEDHSEYKIGNSLDEFMAWVLKVQADLYFHNL KFDGAFIINWLERNGFKWSADGLPNTYNTIISRMGQ WYMIDICLGYKGKRKIHTVIYDSLKKLPFPVKKIAKD FKLTVLKGDIDYHKERPVGYKITPEEYAYIKNDIQIIA EALLIQFKQGLDRMTAGSDSLKGFKDIITTKKFKKVF PTLSLGLDKEVRYAYRGGFTWLNDRFKEKEIGEGMV FDVNSLYPAQMYSRLLPYGEPIVFEGKYVWDEDYPL HIQHIRCEFELKEGYIPTIQIKRSRF YKGNEYLKSSGGEIADLWLSNVDLELMKEHYDLYN VEYISGLKFKATTGLFKDFIDKWFYIKTTSYGAIKQL AKLMLNSLYGKFASNPDVTGKVPYLKENGALGFRL GEEETKDPVYTPMGVFITAWARYTTITAAQACYDRII YCDTDSIHLTGTEIPDVIKDIVDPKKLGYWAHESTFK RAKYLRQKTYIQDIYMKEVDGYLVEGSPDDYTDIKF SVKCAGMTDKIKKEVTFENFKVGFSRKMKPKPVQVP GGVVLVDDTFTIK |

TABLE 14-continued

| SEQ ID NO | Amino Acid Sequence |
| --- | --- |
| 55<br>phi29co. Btagco-His10co-<br>Xaco.N62D_L253A_E375Y_A484E_K512Y. | MSVDGLNDIFEAQKIEWHEAMGHHHHHHHHHHSSG<br>HIEGRHMKHMPRKMYSCDFETTTKVEDCRVWAYG<br>YMNIEDHSEYKIGNSLDEFMAWVLKVQADLYFHDL<br>KFDGAFIINWLERNGFKWSADGLPNTYNTIISRMGQ<br>WYMIDICLGYKGKRKIHTVIYDSLKKLPFPVKKIAKD<br>FKLTVLKGDIDYHKERPVGYKITPEEYAYIKNDIQIIA<br>EALLIQFKQGLDRMTAGSDSLKGFKDIITTKKFKKVF<br>PTLSLGLDKEVRYAYRGGFTWLNDRFKEKEIGEGMV<br>FDVNSAYPAQMYSRLLPYGEPIVFEGKYVWDEDYPL<br>HIQHIRCEFELKEGYIPTIQIKRSRFYKGNEYLKSSGGE<br>IADLWLSNVDLELMKEHYDLYNVEYISGLKFKATTG<br>LFKDFIDKWTYIKTTSYGAIKQLAKLMLNSLYGKFAS<br>NPDVTGKVPYLKENGALGFRLGEEETKDPVYTPMG<br>VFITAWARYTTITAAQACYDRIIYCDTDSIHLTGTEIP<br>DVIKDIVDPKKLGYWEHESTFKRAKYLRQKTYIQDIY<br>MKEVDGYLVEGSPDDYTDIKFSVKCAGMTDKIKKE<br>VTFENFKVGFSRKMKPKPVQVPGGVVLVDDTFTIK |
| 56<br>phi29co. Btagco-His10co-<br>Xaco.N62D_L253A_E375Y_K512Y. | MSVDGLNDIFEAQKIEWHEAMGHHHHHHHHHHSSG<br>HIEGRHMKHMPRKMYSCDFETTTKVEDCRVWAYG<br>YMNIEDHSEYKIGNSLDEFMAWVLKVQADLYFHDL<br>KFDGAFIINWLERNGFKWSADGLPNTYNTIISRMGQ<br>WYMIDICLGYKGKRKIHTVIYDSLKKLPFPVKKIAKD<br>FKLTVLKGDIDYHKERPVGYKITPEEYAYIKNDIQIIA<br>EALLIQFKQGLDRMTAGSDSLKGFKDIITTKKFKKVF<br>PTLSLGLDKEVRYAYRGGFTWLNDRFKEKEIGEGMV<br>FDVNSAYPAQMYSRLLPYGEPIVFEGKYVWDEDYPL<br>HIQHIRCEFELKEGYIPTIQIKRSRFYKGNEYLKSSGGE<br>IADLWLSNVDLELMKEHYDLYNVEYISGLKFKATTG<br>LFKDFIDKWTYIKTTSYGAIKQLAKLMLNSLYGKFAS<br>NPDVTGKVPYLKENGALGFRLGEEETKDPVYTPMG<br>VFITAWARYTTITAAQACYDRIIYCDTDSIHLTGTEIP<br>DVIKDIVDPKKLGYWAHESTFKRAKYLRQKTYIQDI<br>YMKEVDGYLVEGSPDDYTDIKFSVKCAGMTDKIKK<br>EVTFENFKVGFSRKMKPKPVQVPGGVVLVDDTFTIK |
| 57<br>pET16.Btag.His10.Cterm_His10.Phi29.-<br>N62D_T368F_E375Y_A484E_K512Y.co | MSVDGLNDIFEAQKIEWHEAMGHHHHHHHHHHSSG<br>HIEGRHMKHMPRKMYSCDFETTTKVEDCRVWAYG<br>YMNIEDHSEYKIGNSLDEFMAWVLKVQADLYFHDL<br>KFDGAFIINWLERNGFKWSADGLPNTYNTIISRMGQ<br>WYMIDICLGYKGKRKIHTVIYDSLKKLPFPVKKIAKD<br>FKLTVLKGDIDYHKERPVGYKITPEEYAYIKNDIQIIA<br>EALLIQFKQGLDRMTAGSDSLKGFKDIITTKKFKKVF<br>PTLSLGLDKEVRYAYRGGFTWLNDRFKEKEIGEGMV<br>FDVNSLYPAQMYSRLLPYGEPIVFEGKYVWDEDYPL<br>HIQHIRCEFELKEGYIPTIQIKRSRFYKGNEYLKSSGGE<br>IADLWLSNVDLELMKEHYDLYNVEYISGLKFKATTG<br>LFKDFIDKWFYIKTTSYGAIKQLAKLMLNSLYGKFAS<br>NPDVTGKVPYLKENGALGFRLGEEETKDPVYTPMG<br>VFITAWARYTTITAAQACYDRIIYCDTDSIHLTGTEIP<br>DVIKDIVDPKKLGYWEHESTFKRAKYLRQKTYIQDIY<br>MKEVDGYLVEGSPDDYTDIKFSVKCAGMTDKIKKE<br>VTFENFKVGFSRKMKPKPVQVPGGVVLVDDTFTIKG<br>HHHHHHHHHH |
| 58<br>phi29co.Btag-His10-<br>Xa.N62D_T368F_E375Y_A484E_K512Y. | MSVDGLNDIFEAQKIEWHEAMGHHHHHHHHHHSSG<br>HIEGRHMKHMPRKMYSCDFETTTKVEDCRVWAYG<br>YMNIEDHSEYKIGNSLDEFMAWVLKVQADLYFHDL<br>KFDGAFIINWLERNGFKWSADGLPNTYNTIISRMGQ<br>WYMIDICLGYKGKRKIHTVIYDSLKKLPFPVKKIAKD<br>FKLTVLKGDIDYHKERPVGYKITPEEYAYIKNDIQIIA<br>EALLIQFKQGLDRMTAGSDSLKGFKDIITTKKFKKVF<br>PTLSLGLDKEVRYAYRGGFTWLNDRFKEKEIGEGMV<br>FDVNSLYPAQMYSRLLPYGEPIVFEGKYVWDEDYPL<br>HIQHIRCEFELKEGYIPTIQIKRSRFYKGNEYLKSSGGE<br>IADLWLSNVDLELMKEHYDLYNVEYISGLKFKATTG<br>LFKDFIDKWFYIKTTSYGAIKQLAKLMLNSLYGKFAS<br>NPDVTGKVPYLKENGALGFRLGEEETKDPVYTPMG<br>VFITAWARYTTITAAQACYDRIIYCDTDSIHLTGTEIP<br>DVIKDIVDPKKLGYWEHESTFKRAKYLRQKTYIQDIY<br>MKEVDGYLVEGSPDDYTDIKFSVKCAGMTDKIKKE<br>VTFENFKVGFSRKMKPKPVQVPGGVVLVDDTFTIK |
| 59<br>pET16.Btagco.His10co.Cterm_His10.Phi29.-<br>N62D_L253A_E375Y_A484E_K512Y.co | MSVDGLNDIFEAQKIEWHEAMGHHHHHHHHHHSSG<br>HIEGRHMKHMPRKMYSCDFETTTKVEDCRVWAYG<br>YMNIEDHSEYKIGNSLDEFMAWVLKVQADLYFHDL<br>KFDGAFIINWLERNGFKWSADGLPNTYNTIISRMGQ<br>WYMIDICLGYKGKRKIHTVIYDSLKKLPFPVKKIAKD |

TABLE 14-continued

| SEQ ID NO | Amino Acid Sequence |
|---|---|
| | FKLTVLKGDIDYHKERPVGYKITPEEYAYIKNDIQIIA<br>EALLIQFKQGLDRMTAGSDSLKGFKDIITTKKFKKVF<br>PTLSLGLDKEVRYAYRGGFTWLNDRFKEKEIGEGMV<br>FDVNSAYPAQMYSRLLPYGEPIVFEGKYVWDEDYPL<br>HIQHIRCEFELKEGYIPTIQIKRSRFYKGNEYLKSSGGE<br>IADLWLSNVDLELMKEHYDLYNVEYISGLKFKATTG<br>LFKDFIDKWTYIKTTSYGAIKQLAKLMLNSLYGKFAS<br>NPDVTGKVPYLKENGALGFRLGEEETKDPVYTPMG<br>VFITAWARYTTITAAQACYDRIIYCDTDSIHLTGTEIP<br>DVIKDIVDPKKLGYWEHESTFKRAKYLRQKTYIQDIY<br>MKEVDGYLVEGSPDDYTDIKFSVKCAGMTDKIKKE<br>VTFENFKVGFSRKMKPKPVQVPGGVVLVDDTFTIKG<br>HHHHHHHHHH |
| 60<br>pET16.Btagco.His10co.-<br>CTerm_1942Linkco_Ala10co.Phi29.N62D_L253A_E375Y_A484E_K512Y.co | MSVDGLNDIFEAQKIEWHEAMGHHHHHHHHHHSSG<br>HIEGRHMKHMPRKMYSCDFETTTKVEDCRVWAYG<br>YMNIEDHSEYKIGNSLDEFMAWVLKVQADLYFHDL<br>KFDGAFIINWLERNGFKWSADGLPNTYNTIISRMGQ<br>WYMIDICLGYKGKRKIHTVIYDSLKKLPFPVKKIAKD<br>FKLTVLKGDIDYHKERPVGYKITPEEYAYIKNDIQIIA<br>EALLIQFKQGLDRMTAGSDSLKGFKDIITTKKFKKVF<br>PTLSLGLDKEVRYAYRGGFTWLNDRFKEKEIGEGMV<br>FDVNSAYPAQMYSRLLPYGEPIVFEGKYVWDEDYPL<br>HIQHIRCEFELKEGYIPTIQIKRSRFYKGNEYLKSSGGE<br>IADLWLSNVDLELMKEHYDLYNVEYISGLKFKATTG<br>LFKDFIDKWTYIKTTSYGAIKQLAKLMLNSLYGKFAS<br>NPDVTGKVPYLKENGALGFRLGEEETKDPVYTPMG<br>VFITAWARYTTITAAQACYDRIIYCDTDSIHLTGTEIP<br>DVIKDIVDPKKLGYWEHESTFKRAKYLRQKTYIQDIY<br>MKEVDGYLVEGSPDDYTDIKFSVKCAGMTDKIKKE<br>VTFENFKVGFSRKMKPKPVQVPGGVVLVDDTFTIKG<br>GSGGGLGGGLGGAAAAAAAAAA |
| 61<br>pET16.Btagco.His10co.Phi29.-<br>N62D_H149M_T368F_E375Y_D510M_K512Y_D523M.-<br>co | MSVDGLNDIFEAQKIEWHEAMGHHHHHHHHHHSSG<br>HIEGRHMKHMPRKMYSCDFETTTKVEDCRVWAYG<br>YMNIEDHSEYKIGNSLDEFMAWVLKVQADLYFHDL<br>KFDGAFIINWLERNGFKWSADGLPNTYNTIISRMGQ<br>WYMIDICLGYKGKRKIHTVIYDSLKKLPFPVKKIAKD<br>FKLTVLKGDIDYMKERPVGYKITPEEYAYIKNDIQIIA<br>EALLIQFKQGLDRMTAGSDSLKGFKDIITTKKFKKVF<br>PTLSLGLDKEVRYAYRGGFTWLNDRFKEKEIGEGMV<br>FDVNSLYPAQMYSRLLPYGEPIVFEGKYVWDEDYPL<br>HIQHIRCEFELKEGYIPTIQIKRSRFYKGNEYLKSSGGE<br>IADLWLSNVDLELMKEHYDLYNVEYISGLKFKATTG<br>LFKDFIDKWFYIKTTSYGAIKQLAKLMLNSLYGKFAS<br>NPDVTGKVPYLKENGALGFRLGEEETKDPVYTPMG<br>VFITAWARYTTITAAQACYDRIIYCDTDSIHLTGTEIP<br>DVIKDIVDPKKLGYWAHESTFKRAKYLRQKTYIQDI<br>YMKEVMGYLVEGSPDDYTMIKFSVKCAGMTDKIKK<br>EVTFENFKVGFSRKMKPKPVQVPGGVVLVDDTFTIK |
| 62<br>pET16.Btagco.His10co.CTerm_His10.Phi29.-<br>N62H_E375Y_A484E_E508R_K512Y.co | MSVDGLNDIFEAQKIEWHEAMGHHHHHHHHHHSSG<br>HIEGRHMKHMPRKMYSCDFETTTKVEDCRVWAYG<br>YMNIEDHSEYKIGNSLDEFMAWVLKVQADLYFHHL<br>KFDGAFIINWLERNGFKWSADGLPNTYNTIISRMGQ<br>WYMIDICLGYKGKRKIHTVIYDSLKKLPFPVKKIAKD<br>FKLTVLKGDIDYHKERPVGYKITPEEYAYIKNDIQIIA<br>EALLIQFKQGLDRMTAGSDSLKGFKDIITTKKFKKVF<br>PTLSLGLDKEVRYAYRGGFTWLNDRFKEKEIGEGMV<br>FDVNSLYPAQMYSRLLPYGEPIVFEGKYVWDEDYPL<br>HIQHIRCEFELKEGYIPTIQIKRSRFYKGNEYLKSSGGE<br>IADLWLSNVDLELMKEHYDLYNVEYISGLKFKATTG<br>LFKDFIDKWTYIKTTSYGAIKQLAKLMLNSLYGKFAS<br>NPDVTGKVPYLKENGALGFRLGEEETKDPVYTPMG<br>VFITAWARYTTITAAQACYDRIIYCDTDSIHLTGTEIP<br>DVIKDIVDPKKLGYWEHESTFKRAKYLRQKTYIQDIY<br>MKRVDGYLVEGSPDDYTDIKFSVKCAGMTDKIKKE<br>VTFENFKVGFSRKMKPKPVQVPGGVVLVDDTFTIKG<br>HHHHHHHHHH |

TABLE 14-continued

| SEQ ID NO | Amino Acid Sequence |
| --- | --- |
| 63 pET16.Btagco.His10co.CTerm_His10.Phi29.-D12R_N62H_T368F_E375Y_A484E_K512Y.co | MSVDGLNDIFEAQKIEWHEAMGHHHHHHHHHHSSG HIEGRHMKHMPRKMYSCRFETTTKVEDCRVWAYGY MNIEDHSEYKIGNSLDEFMAWVLKVQADLYFHHLK FDGAFIINWLERNGFKWSADGLPNTYNTIISRMGQW YMIDICLGYKGKRKIHTVIYDSLKKLPFPVKKIAKDF KLTVLKGDIDYHKERPVGYKITPEEYAYIKND IQIIAEALLIQFKQGLDRMTAGSDSLKGFKDIITTKKF KKVFPTLSLGLDKEVRYAYRGGFTWLNDRFKEKEIG EGMVFDVNSLYPAQMYSRLLPYGEPIVFEGKYVWD EDYPLHIQHIRCEFELKEGYIPTIQIKRSRFYKGNEYL KSSGGEIADLWLSNVDLELMKEHYDLYNVEYISGLK FKATTGLFKDFIDKWFYIKTTSYGAIKQLAKLMLNSL YGKFASNPDVTGKVPYLKENGALGFRLGEEETKDPV YTPMGVFITAWARYTTITAAQACYDRIIYCDTDSIHL TGTEIPDVIKDIVDPKKLGYWEHESTFKRAKYLRQKT YIQDIYMKEVDGYLVEGSPDDYTDIKFSVKCAGMTD KIKKEVTFENFKVGFSRKMKPKPVQVPGGVVLVDDT FTIKGHHHHHHHHHH |
| 64 pET16.Btagco.His10co.CTerm_His10.Phi29.-D12R_T368F_E375Y_A484E_E508R_511.1K_511.2S_512.1G_512.2S.co | MSVDGLNDIFEAQKIEWHEAMGHHHHHHHHHHSSG HIEGRHMKHMPRKMYSCRFETTTKVEDCRVWAYGY MNIEDHSEYKIGNSLDEFMAWVLKVQADLYFHNLK FDGAFIINWLERNGFKWSADGLPNTYNTIISRMGQW YMIDICLGYKGKRKIHTVIYDSLKKLPFPVKKIAKDF KLTVLKGDIDYHKERPVGYKITPEEYAYIKNDIQIIAE ALLIQFKQGLDRMTAGSDSLKGFKDIITTKKFKKVFP TLSLGLDKEVRYAYRGGFTWLNDRFKEKEIGEGMVF DVNSLYPAQMYSRLLPYGEPIVFEGKYVWDEDYPLH IQHIRCEFELKEGYIPTIQIKRSRFYKGNEYLKSSGGEI ADLWLSNVDLELMKEHYDLYNVEYISGLKFKATTG LFKDFIDKWFYIKTTSYGAIKQLAKLMLNSLYGKFAS NPDVTGKVPYLKENGALGFRLGEEETKDPVYTPMG VFITAWARYTTITAAQACYDRIIYCDTDSIHLTGTEIP DVIKDIVDPKKLGYWEHESTFKRAKYLRQKTYIQDIY MKRVDGKSKGSLVEGSPDDYTDIKFSVKCAGMTDKI KKEVTFENFKVGFSRKMKPKPVQVPGGVVLVDDTFT IKGHHHHHHHHHH |
| 65 pET16.Btagco.His10co.CTerm_His10.Phi29.-D12R_T368F_E375Y_I378W_A484E_E508R_511.1K_511.2S_512.1G_512.-2S.co | MSVDGLNDIFEAQKIEWHEAMGHHHHHHHHHHSSG HIEGRHMKHMPRKMYSCRFETTTKVEDCRVWAYGY MNIEDHSEYKIGNSLDEFMAWVLKVQADLYFHNLK FDGAFIINWLERNGFKWSADGLPNTYNTIISRMGQW YMIDICLGYKGKRKIHTVIYDSLKKLPFPVKKIAKDF KLTVLKGDIDYHKERPVGYKITPEEYAYIKNDIQIIAE ALLIQFKQGLDRMTAGSDSLKGFKDIITTKKFKKVFP TLSLGLDKEVRYAYRGGFTWLNDRFKEKEIGEGMVF DVNSLYPAQMYSRLLPYGEPIVFEGKYVWDEDYPLH IQHIRCEFELKEGYIPTIQIKRSRFYKGNEYLKSSGGEI ADLWLSNVDLELMKEHYDLYNVEYISGLKFKATTG LFKDFIDKWFYIKTTSYGAWKQLAKLMLNSLYGKFA SNPDVTGKVPYLKENGALGFRLGEEETKDPVYTPMG VFITAWARYTTITAAQACYDRIIYCDTDSIHLTGTEIP DVIKDIVDPKKLGYWEHESTFKRAKYLRQKTYIQDIY MKRVDGKSKGSLVEGSPDDYTDIKFSVKCAGMTDKI KKEVTFENFKVGFSRKMKPKPVQVPGGVVLVDDTFT IKGHHHHHHHHHH |
| 66 pET16.Btagco.His10co.Phi29.Y148A_E375Y_A484E_K512Y.co | MSVDGLNDIFEAQKIEWHEAMGHHHHHHHHHHSSG HIEGRHMKHMPRKMYSCDFETTTKVEDCRVWAYG YMNIEDHSEYKIGNSLDEFMAWVLKVQADLYFHNL KFDGAFIINWLERNGFKWSADGLPNTYNTIISRMGQ WYMIDICLGYKGKRKIHTVIYDSLKKLPFPVKKIAKD FKLTVLKGDIDAHKERPVGYKITPEEYAYIKNDIQIIA EALLIQFKQGLDRMTAGSDSLKGFKDIITTKKFKKVF PTLSLGLDKEVRYAYRGGFTWLNDRFKEKEIGEGMV FDVNSLYPAQMYSRLLPYGEPIVFEGKYVWDEDYPL HIQHIRCEFELKEGYIPTIQIKRSRFYKGNEYLKSSGGE IADLWLSNVDLELMKEHYDLYNVEYISGLKFKATTG LFKDFIDKWTYIKTTSYGAIKQLAKLMLNSLYGKFAS NPDVTGKVPYLKENGALGFRLGEEETKDPVYTPMG VFITAWARYTTITAAQACYDRIIYCDTDSIHLTGTEIP DVIKDIVDPKKLGYWEHESTFKRAKYLRQKTYIQDIY MKEVDGYLVEGSPDDYTDIKFSVKCAGMTDKIKKE VTFENFKVGFSRKMKPKPVQVPGGVVLVDDTFTIK |

TABLE 14-continued

| SEQ ID NO | Amino Acid Sequence |
| --- | --- |
| 67<br>pET16.Btagco.His10co.Phi29.-<br>N62D_A190E_E375Y_K422A_A484E_E508R_K512Y.co | MSVDGLNDIFEAQKIEWHEAMGHHHHHHHHHHSSG<br>HIEGRHMKHMPRKMYSCDFETTTKVEDCRVWAYG<br>YMNIEDHSEYKIGNSLDEFMAWVLKVQADLYFHDL<br>KFDGAFIINWLERNGFKWSADGLPNTYNTIISRMGQ<br>WYMIDICLGYKGKRKIHTVIYDSLKKLPFPVKKIAKD<br>FKLTVLKGDIDYHKERPVGYKITPEEYAYIKNDIQIIA<br>EALLIQFKQGLDRMTEGSDSLKGFKDIITTKKFKKVF<br>PTLSLGLDKEVRYAYRGGFTWLNDRFKEKEIGEGMV<br>FDVNSLYPAQMYSRLLPYGEPIVFEGKYVWDEDYPL<br>HIQHIRCEFELKEGYIPTIQIKRSRFYKGNEYLKSSGGE<br>IADLWLSNVDLELMKEHYDLYNVEYISGLKFKATTG<br>LFKDFIDKWTYIKTTSYGAIKQLAKLMLNSLYGKFAS<br>NPDVTGKVPYLKENGALGFRLGEEETADPVYTPMG<br>VFITAWARYTTITAAQACYDRIIYCDTDSIHLTGTEIP<br>DVIKDIVDPKKLGYWEHESTFKRAKYLRQKTYIQDIY<br>MKRVDGYLVEGSPDDYTDIKFSVKCAGMTDKIKKE<br>VTFENFKVGFSRKMKPKPVQVPGGVVLVDDTFTIK |
| 68<br>pET16.Btagco.His10co.CTerm_His10.Phi29.-<br>N62D_I93Y_T368F_T372Y_E375Y_I378W_K478Y_A484E_E508R_511.-<br>1K_511.2S_K512Y_512.1G_512.2S.co | MSVDGLNDIFEAQKIEWHEAMGHHHHHHHHHHSSG<br>HIEGRHMKHMPRKMYSCDFETTTKVEDCRVWAYG<br>YMNIEDHSEYKIGNSLDEFMAWVLKVQADLYFHDL<br>KFDGAFIINWLERNGFKWSADGLPNTYNTYISRMGQ<br>WYMIDICLGYKGKRKIHTVIYDSLKKLPFPVKKIAKD<br>FKLTVLKGDIDYHKERPVGYKITPEEYAYIKNDIQIIA<br>EALLIQFKQGLDRMTAGSDSLKGFKDIITTKKFKKVF<br>PTLSLGLDKEVRYAYRGGFTWLNDRFKEKEIGEGMV<br>FDVNSLYPAQMYSRLLPYGEPIVFEGKYVWDEDYPL<br>HIQHIRCEFELKEGYIPTIQIKRSRFYKGNEYLKSSGGE<br>IADLWLSNVDLELMKEHYDLYNVEYISGLKFKATTG<br>LFKDFIDKWFYIKYTSYGAWKQLAKLMLNSLYGKF<br>ASNPDVTGKVPYLKENGALGFRLGEEETKDPVYTPM<br>GVFITAWARYTTITAAQACYDRIIYCDTDSIHLTGTEI<br>PDVIKDIVDPYKLGYWEHESTFKRAKYLRQKTYIQDI<br>YMKRVDGKSYGSLVEGSPDDYTDIKFSVKCAGMTD<br>KIKKEVTFENFKVGFSRKMKPKPVQVPGGVVLVDDT<br>FTIKGHHHHHHHHHH |
| 69<br>phi29co. Btagco-His10co-<br>Xaco.N62D_T368F_E375Y_P477Q_A484E_K512Y | MSVDGLNDIFEAQKIEWHEAMGHHHHHHHHHHSSG<br>HIEGRHMKHMPRKMYSCDFETTTKVEDCRVWAYG<br>YMNIEDHSEYKIGNSLDEFMAWVLKVQADLYFHDL<br>KFDGAFIINWLERNGFKWSADGLPNTYNTIISRMGQ<br>WYMIDICLGYKGKRKIHTVIYDSLKKLPFPVKKIAKD<br>FKLTVLKGDIDYHKERPVGYKITPEEYAYIKNDIQIIA<br>EALLIQFKQGLDRMTAGSDSLKGFKDIITTKKFKKVF<br>PTLSLGLDKEVRYAYRGGFTWLNDRFKEKEIGEGMV<br>FDVNSLYPAQMYSRLLPYGEPIVFEGKYVWDEDYPL<br>HIQHIRCEFELKEGYIPTIQIKRSRF<br>YKGNEYLKSSGGEIADLWLSNVDLELMKEHYDLYN<br>VEYISGLKFKATTGLFKDFIDKWFYIKTTSYGAIKQL<br>AKLMLNSLYGKFASNPDVTGKVPYLKENGALGFRL<br>GEEETKDPVYTPMGVFITAWARYTTITAAQACYDRII<br>YCDTDSIHLTGTEIPDVIKDIVDQKKLGYWEHESTFK<br>RAKYLRQKTYIQDIYMKEVDGYLVEGSPDDYTDIKF<br>SVKCAGMTDKIKKEVTFENFKVGFSRKMKPKPVQVP<br>GGVVLVDDTFTIK |
| 70<br>pET16.Btagco.His10co.Phi29.N62D_T368F_E375Y_L384M_A484E_K512Y.-<br>co | MSVDGLNDIFEAQKIEWHEAMGHHHHHHHHHHSSG<br>HIEGRHMKHMPRKMYSCDFETTTKVEDCRVWAYG<br>YMNIEDHSEYKIGNSLDEFMAWVLKVQADLYFHDL<br>KFDGAFIINWLERNGFKWSADGLPNTYNTIISRMGQ<br>WYMIDICLGYKGKRKIHTVIYDSLKKLPFPVKKIAKD<br>FKLTVLKGDIDYHKERPVGYKITPEEYAYIKNDIQIIA<br>EALLIQFKQGLDRMTAGSDSLKGFKDIITTKKFKKVF<br>PTLSLGLDKEVRYAYRGGFTWLNDRFKEKEIGEGMV<br>FDVNSLYPAQMYSRLLPYGEPIVFEGKYVWDEDYPL<br>HIQHIRCEFELKEGYIPTIQIKRSRFYKGNEYLKSSGGE<br>IADLWLSNVDLELMKEHYDLYNVEYISGLKFKATTG<br>LFKDFIDKWFYIKTTSYGAIKQLAKMMLNSLYGKFA<br>SNPDVTGKVPYLKENGALGFRLGEEETKDPVYTPMG<br>VFITAWARYTTITAAQACYDRIIYCDTDSIHLTGTEIP<br>DVIKDIVDPKKLGYWEHESTFKRAKYLRQKTYIQDIY<br>MKEVDGYLVEGSPDDYTDIKFSVKCAGMTDKIKKE<br>VTFENFKVGFSRKMKPKPVQVPGGVVLVDDTFTIK |

TABLE 14-continued

| SEQ ID NO | Amino Acid Sequence |
| --- | --- |
| 71<br>phi29co.Btagco-His10co-<br>Xaco.T368F_E375Y_P477E_K512Y. | MSVDGLNDIFEAQKIEWHEAMGHHHHHHHHHHSSG<br>HIEGRHMKHMPRKMYSCDFETTTKVEDCRVWAYG<br>YMNIEDHSEYKIGNSLDEFMAWVLKVQADLYFHNL<br>KFDGAFIINWLERNGFKWSADGLPNTYNTIISRMGQ<br>WYMIDICLGYKGKRKIHTVIYDSLKKLPFPVKKIAKD<br>FKLTVLKGDIDYHKERPVGYKITPEEYAYIKNDIQIIA<br>EALLIQFKQGLDRMTAGSDSLKGFKDIITTKKFKKVF<br>PTLSLGLDKEVRYAYRGGFTWLNDRFKEKEIGEGMV<br>FDVNSLYPAQMYSRLLPYGEPIVFEGKYVWDEDYPL<br>HIQHIRCEFELKEGYIPTIQIKRSRFYKGNEYLKSSGGE<br>IADLWLSNVDLELMKEHYDLYNVEYISGLKFKATTG<br>LFKDFIDKWFYIKTTSYGAIKQLAKLMLNSLYGKFAS<br>NPDVTGKVPYLKENGALGFRLGEEETKDPVYTPMG<br>VFITAWARYTTITAAQACYDRIIYCDTDSIHLTGTEIP<br>DVIKDIVDEKKLGYWAHESTFKRAKYLRQKTYIQDI<br>YMKEVDGYLVEGSPDDYTDIKFSVKCAGMTDKIKK<br>EVTFENFKVGFSRKMKPKPVQVPGGVVLVDDTFTIK |
| 72<br>phi29co. Btagco-His10co-<br>Xaco.A176V_T368F_E375Y_K512Y. | MSVDGLNDIFEAQKIEWHEAMGHHHHHHHHHHSSG<br>HIEGRHMKHMPRKMYSCDFETTTKVEDCRVWAYG<br>YMNIEDHSEYKIGNSLDEFMAWVLKVQADLYFHNL<br>KFDGAFIINWLERNGFKWSADGLPNTYNTIISRMGQ<br>WYMIDICLGYKGKRKIHTVIYDSLKKLPFPVKKIAKD<br>FKLTVLKGDIDYHKERPVGYKITPEEYAYIKNDIQIIA<br>EVLLIQFKQGLDRMTAGSDSLKGFKDIITTKKFKKVF<br>PTLSLGLDKEVRYAYRGGFTWLNDRFKEKEIGEGMV<br>FDVNSLYPAQMYSRLLPYGEPIVFEGKYVWDEDYPL<br>HIQHIRCEFELKEGYIPTIQIKRSRFYKGNEYLKSSGGE<br>IADLWLSNVDLELMKEHYDLYNVEYISGLKFKATTG<br>LFKDFIDKWFYIKTTSYGAIKQLAKLMLNSLYGKFAS<br>NPDVTGKVPYLKENGALGFRLGEEETKDPVYTPMG<br>VFITAWARYTTITAAQACYDRIIYCDTDSIHLTGTEIP<br>DVIKDIVDPKKLGYWAHESTFKRAKYLRQKTYIQDI<br>YMKEVDGYLVEGSPDDYTDIKFSVKCAGMTDKIKK<br>EVTFENFKVGFSRKMKPKPVQVPGGVVLVDDTFTIK |
| 73<br>phi29co.Btagco-His10co-<br>Xaco.T368F_E375Y_K422R_K512Y. | MSVDGLNDIFEAQKIEWHEAMGHHHHHHHHHHSSG<br>HIEGRHMKHMPRKMYSCDFETTTKVEDCRVWAYG<br>YMNIEDHSEYKIGNSLDEFMAWVLKVQADLYFHNL<br>KFDGAFIINWLERNGFKWSADGLPNTYNTIISRMGQ<br>WYMIDICLGYKGKRKIHTVIYDSLKKLPFPVKKIAKD<br>FKLTVLKGDIDYHKERPVGYKITPEEYAYIKNDIQIIA<br>EALLIQFKQGLDRMTAGSDSLKGFKDIITTKKFKKVF<br>PTLSLGLDKEVRYAYRGGFTWLNDRFKEKEIGEGMV<br>FDVNSLYPAQMYSRLLPYGEPIVFEGKYVWDEDYPL<br>HIQHIRCEFELKEGYIPTIQIKRSRFYKGNEYLKSSGGE<br>IADLWLSNVDLELMKEHYDLYNVEYISGLKFKATTG<br>LFKDFIDKWFYIKTTSYGAIKQLAKLMLNSLYGKFAS<br>NPDVTGKVPYLKENGALGFRLGEEETRDPVYTPMGV<br>FITAWARYTTITAAQACYDRIIYCDTDSIHLTGTEIPD<br>VIKDIVDPKKLGYWAHESTFKRAKYLRQKTYIQDIY<br>MKEVDGYLVEGSPDDYTDIKFSVKCAGMTDKIKKE<br>VTFENFKVGFSRKMKPKPVQVPGGVVLVDDTFTIK |
| 74<br>pET16.Btagco.His10co.Phi29.N62D_E375Y_P477Q_A484E_K512Y.co | MSVDGLNDIFEAQKIEWHEAMGHHHHHHHHHHSSG<br>HIEGRHMKHMPRKMYSCDFETTTKVEDCRVWAYG<br>YMNIEDHSEYKIGNSLDEFMAWVLKVQADLYFHDL<br>KFDGAFIINWLERNGFKWSADGLPNTYNTIISRMGQ<br>WYMIDICLGYKGKRKIHTVIYDSLKKLPFPVKKIAKD<br>FKLTVLKGDIDYHKERPVGYKITPEEYAYIKNDIQIIA<br>EALLIQFKQGLDRMTAGSDSLKGFKDIITTKKFKKVF<br>PTLSLGLDKEVRYAYRGGFTWLNDRFKEKEIGEGMV<br>FDVNSLYPAQMYSRLLPYGEPIVFEGKYVWDEDYPL<br>HIQHIRCEFELKEGYIPTIQIKRSRFYKGNEYLKSSGGE<br>IADLWLSNVDLELMKEHYDLYNVEYISGLKFKATTG<br>LFKDFIDKWTYIKTTSYGAIKQLAKLMLNSLYGKFAS<br>NPDVTGKVPYLKENGALGFRLGEEETKDPVYTPMG<br>VFITAWARYTTITAAQACYDRIIYCDTDSIHLTGTEIP<br>DVIKDIVDQKKLGYWEHESTFKRAKYLRQKTYIQDI<br>YMKEVDGYLVEGSPDDYTDIKFSVKCAGMTDKIKK<br>EVTFENFKVGFSRKMKPKPVQVPGGVVLVDDTFTIK |
| 75<br>phi29co.Btagco-His10co-<br>Xaco.I93F_T368F_E375Y_A484E_K512Y. | MSVDGLNDIFEAQKIEWHEAMGHHHHHHHHHHSSG<br>HIEGRHMKHMPRKMYSCDFETTTKVEDCRVWAYG<br>YMNIEDHSEYKIGNSLDEFMAWVLKVQADLYFHNL<br>KFDGAFIINWLERNGFKWSADGLPNTYNTFISRMGQ<br>WYMIDICLGYKGKRKIHTVIYDSLKKLPFPVKKIAKD<br>FKLTVLKGDIDYHKERPVGYKITPEEYAYIKNDIQIIA |

TABLE 14-continued

| SEQ ID NO | Amino Acid Sequence |
| --- | --- |
| | EALLIQFKQGLDRMTAGSDSLKGFKDIITTKKFKKVF
PTLSLGLDKEVRYAYRGGFTWLNDRFKEKEIGEGMV
FDVNSLYPAQMYSRLLPYGEPIVFEGKYVWDEDYPL
HIQHIRCEFELKEGYIPTIQIKRSRF
YKGNEYLKSSGGEIADLWLSNVDLELMKEHYDLYN
VEYISGLKFKATTGLFKDFIDKWFYIKTTSYGAIKQL
AKLMLNSLYGKFASNPDVTGKVPYLKENGALGFRL
GEEETKDPVYTPMGVFITAWARYTTITAAQACYDRII
YCDTDSIHLTGTEIPDVIKDIVDPKKLGYWEHESTFK
RAKYLRQKTYIQDIYMKEVDGYLVEGSPDDYTDIKF
SVKCAGMTDKIKKEVTFENFKVGFSRKMKPKPVQVP
GGVVLVDDTFTIK |
| 76
pET16.Btagco.His10co.Phi29.L253A_E375Y_A484E_K512Y.co | MSVDGLNDIFEAQKIEWHEAMGHHHHHHHHHHSSG
HIEGRHMKHMPRKMYSCDFETTTKVEDCRVWAYG
YMNIEDHSEYKIGNSLDEFMAWVLKVQADLYFHNL
KFDGAFIINWLERNGFKWSADGLPNTYNTIISRMGQ
WYMIDICLGYKGKRKIHTVIYDSLKKLPFPVKKIAKD
FKLTVLKGDIDYHKERPVGYKITPEEYAYIKNDIQIIA
EALLIQFKQGLDRMTAGSDSLKGFKDIITTKKFKKVF
PTLSLGLDKEVRYAYRGGFTWLNDRFKEKEIGEGMV
FDVNSAYPAQMYSRLLPYGEPIVFEGKYVWDEDYPL
HIQHIRCEFELKEGYIPTIQIKRSRFYKGNEYLKSSGGE
IADLWLSNVDLELMKEHYDLYNVEYISGLKFKATTG
LFKDFIDKWTYIKTTSYGAIKQLAKLMLNSLYGKFAS
NPDVTGKVPYLKENGALGFRLGEEETKDPVYTPMG
VFITAWARYTTITAAQACYDRIIYCDTDSIHLTGTEIP
DVIKDIVDPKKLGYWEHESTFKRAKYLRQKTYIQDIY
MKEVDGYLVEGSPDDYTDIKFSVKCAGMTDKIKKE
VTFENFKVGFSRKMKPKPVQVPGGVVLVDDTFTIK |
| 77
Btagco.His10co.N62D_L253A_E375Y_E420M_A484E_K512Y.co | MSVDGLNDIFEAQKIEWHEAMGHHHHHHHHHHSSG
HIEGRHMKHMPRKMYSCDFETTTKVEDCRVWAYG
YMNIEDHSEYKIGNSLDEFMAWVLKVQADLYFHDL
KFDGAFIINWLERNGFKWSADGLPNTYNTIISRMGQ
WYMIDICLGYKGKRKIHTVIYDSLKKLPFPVKKIAKD
FKLTVLKGDIDYHKERPVGYKITPEEYAYIKNDIQIIA
EALLIQFKQGLDRMTAGSDSLKGFKDIITTKKFKKVF
PTLSLGLDKEVRYAYRGGFTWLNDRFKEKEIGEGMV
FDVNSAYPAQMYSRLLPYGEPIVFEGKYVWDEDYPL
HIQHIRCEFELKEGYIPTIQIKRSRFYKGNEYLKSSGGE
IADLWLSNVDLELMKEHYDLYNVEYISGLKFKATTG
LFKDFIDKWTYIKTTSYGAIKQLAKLMLNSLYGKFAS
NPDVTGKVPYLKENGALGFRLGEEMTKDPVYTPMG
VFITAWARYTTITAAQACYDRIIYCDTDSIHLTGTEIP
DVIKDIVDPKKLGYWEHESTFKRAKYLRQKTYIQDIY
MKEVDGYLVEGSPDDYTDIKFSVKCAGMTDKIKKE
VTFENFKVGFSRKMKPKPVQVPGGVVLVDDTFTIK |
| 78
Btagco.His10co.N62D_L253A_E375Y_K422A_A484E_K512Y.co | MSVDGLNDIFEAQKIEWHEAMGHHHHHHHHHHSSG
HIEGRHMKHMPRKMYSCDFETTTKVEDCRVWAYG
YMNIEDHSEYKIGNSLDEFMAWVLKVQADLYFHDL
KFDGAFIINWLERNGFKWSADGLPNTYNTIISRMGQ
WYMIDICLGYKGKRKIHTVIYDSLKKLPFPVKKIAKD
FKLTVLKGDIDYHKERPVGYKITPEEYAYIKNDIQIIA
EALLIQFKQGLDRMTAGSDSLKGFKDIITTKKFKKVF
PTLSLGLDKEVRYAYRGGFTWLNDRFKEKEIGEGMV
FDVNSAYPAQMYSRLLPYGEPIVFEGKYVWDEDYPL
HIQHIRCEFELKEGYIPTIQIKRSRFYKGNEYLKSSGGE
IADLWLSNVDLELMKEHYDLYNVEYISGLKFKATTG
LFKDFIDKWTYIKTTSYGAIKQLAKLMLNSLYGKFAS
NPDVTGKVPYLKENGALGFRLGEEETADPVYTPMG
VFITAWARYTTITAAQACYDRIIYCDTDSIHLTGTEIP
DVIKDIVDPKKLGYWEHESTFKRAKYLRQKTYIQDIY
MKEVDGYLVEGSPDDYTDIKFSVKCAGMTDKIKKE
VTFENFKVGFSRKMKPKPVQVPGGVVLVDDTFTIK |
| 79
Btagco.His10co.N62D_L253A_E375Y_A484E_E508K_K512Y.co | MSVDGLNDIFEAQKIEWHEAMGHHHHHHHHHHSSG
HIEGRHMKHMPRKMYSCDFETTTKVEDCRVWAYG
YMNIEDHSEYKIGNSLDEFMAWVLKVQADLYFHDL
KFDGAFIINWLERNGFKWSADGLPNTYNTIISRMGQ
WYMIDICLGYKGKRKIHTVIYDSLKKLPFPVKKIAKD
FKLTVLKGDIDYHKERPVGYKITPEEYAYIKNDIQIIA
EALLIQFKQGLDRMTAGSDSLKGFKDIITTKKFKKVF
PTLSLGLDKEVRYAYRGGFTWLNDRFKEKEIGEGMV
FDVNSAYPAQMYSRLLPYGEPIVFEGKYVWDEDYPL
HIQHIRCEFELKEGYIPTIQIKRSRFYKGNEYLKSSGGE
IADLWLSNVDLELMKEHYDLYNVEYISGLKFKATTG |

TABLE 14-continued

| SEQ ID NO | Amino Acid Sequence |
|---|---|
| | LFKDFIDKWTYIKTTSYGAIKQLAKLMLNSLYGKFAS<br>NPDVTGKVPYLKENGALGFRLGEEETKDPVYTPMG<br>VFITAWARYTTITAAQACYDRIIYCDTDSIHLTGTEIP<br>DVIKDIVDPKKLGYWEHESTFKRAKYLRQKTYIQDIY<br>MKKVDGYLVEGSPDDYTDIKFSVKCAGMTDKIKKE<br>VTFENFKVGFSRKMKPKPVQVPGGVVLVDDTFTIK |
| 80<br>Btagco.His10co.N62D_S215D_L253A_E375Y_A484E_K512Y.co | MSVDGLNDIFEAQKIEWHEAMGHHHHHHHHHHSSG<br>HIEGRHMKHMPRKMYSCDFETTTKVEDCRVWAYG<br>YMNIEDHSEYKIGNSLDEFMAWVLKVQADLYFHDL<br>KFDGAFIINWLERNGFKWSADGLPNTYNTIISRMGQ<br>WYMIDICLGYKGKRKIHTVIYDSLKKLPFPVKKIAKD<br>FKLTVLKGDIDYHKERPVGYKITPEEYAYIKNDIQIIA<br>EALLIQFKQGLDRMTAGSDSLKGFKDIITTKKFKKVF<br>PTLDLGLDKEVRYAYRGGFTWLNDRFKEKEIGEGM<br>VFDVNSAYPAQMYSRLLPYGEPIVFEGKYVWDEDYP<br>LHIQHIRCEFELKEGYIPTIQIKRSRFYKGNEYLKSSGG<br>EIADLWLSNVDLELMKEHYDLYNVEYISGLKFKATT<br>GLFKDFIDKWTYIKTTSYGAIKQLAKLMLNSLYGKF<br>ASNPDVTGKVPYLKENGALGFRLGEEETKDPVYTPM<br>GVFITAWARYTTITAAQACYDRIIYCDTDSIHLTGTEI<br>PDVIKDIVDPKKLGYWEHESTFKRAKYLRQKTYIQDI<br>YMKEVDGYLVEGSPDDYTDIKFSVKCAGMTDKIKK<br>EVTFENFKVGFSRKMKPKPVQVPGGVVLVDDTFTIK |
| 81<br>Btagco.His10co.N62D_L253T_E375Y_A484E_K512Y.co | MSVDGLNDIFEAQKIEWHEAMGHHHHHHHHHHSSG<br>HIEGRHMKHMPRKMYSCDFETTTKVEDCRVWAYG<br>YMNIEDHSEYKIGNSLDEFMAWVLKVQADLYFHDL<br>KFDGAFIINWLERNGFKWSADGLPNTYNTIISRMGQ<br>WYMIDICLGYKGKRKIHTVIYDSLKKLPFPVKKIAKD<br>FKLTVLKGDIDYHKERPVGYKITPEEYAYIKNDIQIIA<br>EALLIQFKQGLDRMTAGSDSLKGFKDIITTKKFKKVF<br>PTLSLGLDKEVRYAYRGGFTWLNDRFKEKEIGEGMV<br>FDVNSTYPAQMYSRLLPYGEPIVFEGKYVWDEDYPL<br>HIQHIRCEFELKEGYIPTIQIKRSRFYKGNEYLKSSGGE<br>IADLWLSNVDLELMKEHYDLYNVEYISGLKFKATTG<br>LFKDFIDKWTYIKTTSYGAIKQLAKLMLNSLYGKFAS<br>NPDVTGKVPYLKENGALGFRLGEEETKDPVYTPMG<br>VFITAWARYTTITAAQACYDRIIYCDTDSIHLTGTEIP<br>DVIKDIVDPKKLGYWEHESTFKRAKYLRQKTYIQDIY<br>MKEVDGYLVEGSPDDYTDIKFSVKCAGMTDKIKKE<br>VTFENFKVGFSRKMKPKPVQVPGGVVLVDDTFTIK |
| 82<br>Btagco.His10co.N62D_L253A_Y369H_E375Y_A484E_K512Y.co | MSVDGLNDIFEAQKIEWHEAMGHHHHHHHHHHSSG<br>HIEGRHMKHMPRKMYSCDFETTTKVEDCRVWAYG<br>YMNIEDHSEYKIGNSLDEFMAWVLKVQADLYFHDL<br>KFDGAFIINWLERNGFKWSADGLPNTYNTIISRMGQ<br>WYMIDICLGYKGKRKIHTVIYDSLKKLPFPVKKIAKD<br>FKLTVLKGDIDYHKERPVGYKITPEEYAYIKNDIQIIA<br>EALLIQFKQGLDRMTAGSDSLKGFKDIITTKKFKKVF<br>PTLSLGLDKEVRYAYRGGFTWLNDRFKEKEIGEGMV<br>FDVNSAYPAQMYSRLLPYGEPIVFEGKYVWDEDYPL<br>HIQHIRCEFELKEGYIPTIQIKRSRFYKGNEYLKSSGGE<br>IADLWLSNVDLELMKEHYDLYNVEYISGLKFKATTG<br>LFKDFIDKWTHIKTTSYGAIKQLAKLMLNSLYGKFAS<br>NPDVTGKVPYLKENGALGFRLGEEETKDPVYTPMG<br>VFITAWARYTTITAAQACYDRIIYCDTDSIHLTGTEIP<br>DVIKDIVDPKKLGYWEHESTFKRAKYLRQKTYIQDIY<br>MKEVDGYLVEGSPDDYTDIKFSVKCAGMTDKIKKE<br>VTFENFKVGFSRKMKPKPVQVPGGVVLVDDTFTIK |
| 83<br>Btagco.His10co.N62D_L253A_Y369G_E375Y_A484E_K512Y.co | MSVDGLNDIFEAQKIEWHEAMGHHHHHHHHHHSSG<br>HIEGRHMKHMPRKMYSCDFETTTKVEDCRVWAYG<br>YMNIEDHSEYKIGNSLDEFMAWVLKVQADLYFHDL<br>KFDGAFIINWLERNGFKWSADGLPNTYNTIISRMGQ<br>WYMIDICLGYKGKRKIHTVIYDSLKKLPFPVKKIAKD<br>FKLTVLKGDIDYHKERPVGYKITPEEYAYIKNDIQIIA<br>EALLIQFKQGLDRMTAGSDSLKGFKDIITTKKFKKVF<br>PTLSLGLDKEVRYAYRGGFTWLNDRFKEKEIGEGMV<br>FDVNSAYPAQMYSRLLPYGEPIVFEGKYVWDEDYPL<br>HIQHIRCEFELKEGYIPTIQIKRSRFYKGNEYLKSSGGE<br>IADLWLSNVDLELMKEHYDLYNVEYISGLKFKATTG<br>LFKDFIDKWTGIKTTSYGAIKQLAKLMLNSLYGKFAS<br>NPDVTGKVPYLKENGALGFRLGEEETKDPVYTPMG<br>VFITAWARYTTITAAQACYDRIIYCDTDSIHLTGTEIP<br>DVIKDIVDPKKLGYWEHESTFKRAKYLRQKTYIQDIY<br>MKEVDGYLVEGSPDDYTDIKFSVKCAGMTDKIKKE<br>VTFENFKVGFSRKMKPKPVQVPGGVVLVDDTFTIK |

TABLE 14-continued

| SEQ ID NO | Amino Acid Sequence |
| --- | --- |
| 84<br>Btagco.His10co.N62D_L253A_Y369L_E375Y_A484E_K512Y.co | MSVDGLNDIFEAQKIEWHEAMGHHHHHHHHHHSSG<br>HIEGRHMKHMPRKMYSCDFETTTKVEDCRVWAYG<br>YMNIEDHSEYKIGNSLDEFMAWVLKVQADLYFHDL<br>KFDGAFIINWLERNGFKWSADGLPNTYNTIISRMGQ<br>WYMIDICLGYKGKRKIHTVIYDSLKKLPFPVKKIAKD<br>FKLTVLKGDIDYHKERPVGYKITPEEYAYIKNDIQIIA<br>EALLIQFKQGLDRMTAGSDSLKGFKDIITTKKFKKVF<br>PTLSLGLDKEVRYAYRGGFTWLNDRFKEKEIGEGMV<br>FDVNSAYPAQMYSRLLPYGEPIVFEGKYVWDEDYPL<br>HIQHIRCEFELKEGYIPTIQIKRSRFYKGNEYLKSSGGE<br>IADLWLSNVDLELMKEHYDLYNVEYISGLKFKATTG<br>LFKDFIDKWTLIKTTSYGAIKQLAKLMLNSLYGKFAS<br>NPDVTGKVPYLKENGALGFRLGEEETKDPVYTPMG<br>VFITAWARYTTITAAQACYDRIIYCDTDSIHLTGTEIP<br>DVIKDIVDPKKLGYWEHESTFKRAKYLRQKTYIQDIY<br>MKEVDGYLVEGSPDDYTDIKFSVKCAGMTDKIKKE<br>VTFENFKVGFSRKMKPKPVQVPGGVVLVDDTFTIK |
| 85<br>Btagco.His10co.N62D_L253A_E375F_A484E_K512Y.co | MSVDGLNDIFEAQKIEWHEAMGHHHHHHHHHHSSG<br>HIEGRHMKHMPRKMYSCDFETTTKVEDCRVWAYG<br>YMNIEDHSEYKIGNSLDEFMAWVLKVQADLYFHDL<br>KFDGAFIINWLERNGFKWSADGLPNTYNTIISRMGQ<br>WYMIDICLGYKGKRKIHTVIYDSLKKLPFPVKKIAKD<br>FKLTVLKGDIDYHKERPVGYKITPEEYAYIKNDIQIIA<br>EALLIQFKQGLDRMTAGSDSLKGFKDIITTKKFKKVF<br>PTLSLGLDKEVRYAYRGGFTWLNDRFKEKEIGEGMV<br>FDVNSAYPAQMYSRLLPYGEPIVFEGKYVWDEDYPL<br>HIQHIRCEFELKEGYIPTIQIKRSRFYKGNEYLKSSGGE<br>IADLWLSNVDLELMKEHYDLYNVEYISGLKFKATTG<br>LFKDFIDKWTYIKTTSFGAIKQLAKLMLNSLYGKFAS<br>NPDVTGKVPYLKENGALGFRLGEEETKDPVYTPMG<br>VFITAWARYTTITAAQACYDRIIYCDTDSIHLTGTEIP<br>DVIKDIVDPKKLGYWEHESTFKRAKYLRQKTYIQDIY<br>MKEVDGYLVEGSPDDYTDIKFSVKCAGMTDKIKKE<br>VTFENFKVGFSRKMKPKPVQVPGGVVLVDDTFTIK |
| 86<br>Btagco.His10co.D66R_L253A_E375Y_A484E_K512Y.co | MSVDGLNDIFEAQKIEWHEAMGHHHHHHHHHHSSG<br>HIEGRHMKHMPRKMYSCDFETTTKVEDCRVWAYG<br>YMNIEDHSEYKIGNSLDEFMAWVLKVQADLYFHNL<br>KFRGAFIINWLERNGFKWSADGLPNTYNTIISRMGQ<br>WYMIDICLGYKGKRKIHTVIYDSLKKLPFPVKKIAKD<br>FKLTVLKGDIDYHKERPVGYKITPEEYAYIKNDIQIIA<br>EALLIQFKQGLDRMTAGSDSLKGFKDIITTKKFKKVF<br>PTLSLGLDKEVRYAYRGGFTWLNDRFKEKEIGEGMV<br>FDVNSAYPAQMYSRLLPYGEPIVFEGKYVWDEDYPL<br>HIQHIRCEFELKEGYIPTIQIKRSRFYKGNEYLKSSGGE<br>IADLWLSNVDLELMKEHYDLYNVEYISGLKFKATTG<br>LFKDFIDKWTYIKTTSYGAIKQLAKLMLNSLYGKFAS<br>NPDVTGKVPYLKENGALGFRLGEEETKDPVYTPMG<br>VFITAWARYTTITAAQACYDRIIYCDTDSIHLTGTEIP<br>DVIKDIVDPKKLGYWEHESTFKRAKYLRQKTYIQDIY<br>MKEVDGYLVEGSPDDYTDIKFSVKCAGMTDKIKKE<br>VTFENFKVGFSRKMKPKPVQVPGGVVLVDDTFTIK |
| 87<br>Btagco.His10co.N62D_L253A_E375Y_A484E_I504R_K512Y.co | MSVDGLNDIFEAQKIEWHEAMGHHHHHHHHHHSSG<br>HIEGRHMKHMPRKMYSCDFETTTKVEDCRVWAYG<br>YMNIEDHSEYKIGNSLDEFMAWVLKVQADLYFHDL<br>KFDGAFIINWLERNGFKWSADGLPNTYNTIISRMGQ<br>WYMIDICLGYKGKRKIHTVIYDSLKKLPFPVKKIAKD<br>FKLTVLKGDIDYHKERPVGYKITPEEYAYIKNDIQIIA<br>EALLIQFKQGLDRMTAGSDSLKGFKDIITTKKFKKVF<br>PTLSLGLDKEVRYAYRGGFTWLNDRFKEKEIGEGMV<br>FDVNSAYPAQMYSRLLPYGEPIVFEGKYVWDEDYPL<br>HIQHIRCEFELKEGYIPTIQIKRSRFYKGNEYLKSSGGE<br>IADLWLSNVDLELMKEHYDLYNVEYISGLKFKATTG<br>LFKDFIDKWTYIKTTSYGAIKQLAKLMLNSLYGKFAS<br>NPDVTGKVPYLKENGALGFRLGEEETKDPVYTPMG<br>VFITAWARYTTITAAQACYDRIIYCDTDSIHLTGTEIP<br>DVIKDIVDPKKLGYWEHESTFKRAKYLRQKTYIQDR<br>YMKEVDGYLVEGSPDDYTDIKFSVKCAGMTDKIKK<br>EVTFENFKVGFSRKMKPKPVQVPGGVVLVDDTFTIK |
| 88<br>Btagco.His10co.N62D_L253A_E375Y_A484E_D510K_K512Y.co | MSVDGLNDIFEAQKIEWHEAMGHHHHHHHHHHSSG<br>HIEGRHMKHMPRKMYSCDFETTTKVEDCRVWAYG<br>YMNIEDHSEYKIGNSLDEFMAWVLKVQADLYFHDL<br>KFDGAFIINWLERNGFKWSADGLPNTYNTIISRMGQ<br>WYMIDICLGYKGKRKIHTVIYDSLKKLPFPVKKIAKD |

TABLE 14-continued

| SEQ ID NO | Amino Acid Sequence |
|---|---|
| | FKLTVLKGDIDYHKERPVGYKITPEEYAYIKNDIQIIA<br>EALLIQFKQGLDRMTAGSDSLKGFKDIITTKKFKKVF<br>PTLSLGLDKEVRYAYRGGFTWLNDRFKEKEIGEGMV<br>FDVNSAYPAQMYSRLLPYGEPIVFEGKYVWDEDYPL<br>HIQHIRCEFELKEGYIPTIQIKRSRFYKGNEYLKSSGGE<br>IADLWLSNVDLELMKEHYDLYNVEYISGLKFKATTG<br>LFKDFIDKWTYIKTTSYGAIKQLAKLMLNSLYGKFAS<br>NPDVTGKVPYLKENGALGFRLGEEETKDPVYTPMG<br>VFITAWARYTTITAAQACYDRIIYCDTDSIHLTGTEIP<br>DVIKDIVDPKKLGYWEHESTFKRAKYLRQKTYIQDIY<br>MKEVKGYLVEGSPDDYTDIKFSVKCAGMTDKIKKE<br>VTFENFKVGFSRKMKPKPVQVPGGVVLVDDTFTIK |
| 89<br>Btagco.His10co.CTerm_His10.L253A_E375Y_A484E_K512Y.co | MSVDGLNDIFEAQKIEWHEAMGHHHHHHHHHHSSG<br>HIEGRHMKHMPRKMYSCDFETTTKVEDCRVWAYG<br>YMNIEDHSEYKIGNSLDEFMAWVLKVQADLYFHNL<br>KFDGAFIINWLERNGFKWSADGLPNTYNTIISRMGQ<br>WYMIDICLGYKGKRKIHTVIYDSLKKLPFPVKKIAKD<br>FKLTVLKGDIDYHKERPVGYKITPEEYAYIKNDIQIIA<br>EALLIQFKQGLDRMTAGSDSLKGFKDIITTKKFKKVF<br>PTLSLGLDKEVRYAYRGGFTWLNDRFKEKEIGEGMV<br>FDVNSAYPAQMYSRLLPYGEPIVFEGKYVWDEDYPL<br>HIQHIRCEFELKEGYIPTIQIKRSRFYKGNEYLKSSGGE<br>IADLWLSNVDLELMKEHYDLYNVEYISGLKFKATTG<br>LFKDFIDKWTYIKTTSYGAIKQLAKLMLNSLYGKFAS<br>NPDVTGKVPYLKENGALGFRLGEEETKDPVYTPMG<br>VFITAWARYTTITAAQACYDRIIYCDTDSIHLTGTEIP<br>DVIKDIVDPKKLGYWEHESTFKRAKYLRQKTYIQDIY<br>MKEVDGYLVEGSPDDYTDIKFSVKCAGMTDKIKKE<br>VTFENFKVGFSRKMKPKPVQVPGGVVLVDDTFTIKG<br>HHHHHHHHHH |
| 90<br>BtagV7co.His10co.CTerm_His10co.L253A_E375Y_A484E_K512Y.co | MSVDGLNDFFEAQKIEWHEAMGHHHHHHHHHHSS<br>GHIEGRHMKHMPRKMYSCDFETTTKVEDCRVWAY<br>GYMNIEDHSEYKIGNSLDEFMAWVLKVQADLYFHN<br>LKFDGAFIINWLERNGFKWSADGLPNTYNTIISRMGQ<br>WYMIDICLGYKGKRKIHTVIYDSLKKLPFPVKKIAKD<br>FKLTVLKGDIDYHKERPVGYKITPEEYAYIKNDIQIIA<br>EALLIQFKQGLDRMTAGSDSLKGFKDIITTKKFKKVF<br>PTLSLGLDKEVRYAYRGGFTWLNDRFKEKEIGEGMV<br>FDVNSAYPAQMYSRLLPYGEPIVFEGKYVWDEDYPL<br>HIQHIRCEFELKEGYIPTIQIKRSRFYKGNEYLKSSGGE<br>IADLWLSNVDLELMKEHYDLYNVEYISGLKFKATTG<br>LFKDFIDKWTYIKTTSYGAIKQLAKLMLNSLYGKFAS<br>NPDVTGKVPYLKENGALGFRLGEEETKDPVYTPMG<br>VFITAWARYTTITAAQACYDRIIYCDTDSIHLTGTEIP<br>DVIKDIVDPKKLGYWEHESTFKRAKYLRQKTYIQDIY<br>MKEVDGYLVEGSPDDYTDIKFSVKCAGMTDKIKKE<br>VTFENFKVGFSRKMKPKPVQVPGGVVLVDDTFTIKG<br>HHHHHHHHHH |
| 91<br>Btagco.His10co.CTerm_His10co.L253A_E375Y_A484E_E508R_K512Y.co | MSVDGLNDIFEAQKIEWHEAMGHHHHHHHHHHSSG<br>HIEGRHMKHMPRKMYSCDFETTTKVEDCRVWAYG<br>YMNIEDHSEYKIGNSLDEFMAWVLKVQADLYFHNL<br>KFDGAFIINWLERNGFKWSADGLPNTYNTIISRMGQ<br>WYMIDICLGYKGKRKIHTVIYDSLKKLPFPVKKIAKD<br>FKLTVLKGDIDYHKERPVGYKITPEEYAYIKNDIQIIA<br>EALLIQFKQGLDRMTAGSDSLKGFKDIITTKKFKKVF<br>PTLSLGLDKEVRYAYRGGFTWLNDRFKEKEIGEGMV<br>FDVNSAYPAQMYSRLLPYGEPIVFEGKYVWDEDYPL<br>HIQHIRCEFELKEGYIPTIQIKRSRFYKGNEYLKSSGGE<br>IADLWLSNVDLELMKEHYDLYNVEYISGLKFKATTG<br>LFKDFIDKWTYIKTTSYGAIKQLAKLMLNSLYGKFAS<br>NPDVTGKVPYLKENGALGFRLGEEETKDPVYTPMG<br>VFITAWARYTTITAAQACYDRIIYCDTDSIHLTGTEIP<br>DVIKDIVDPKKLGYWEHESTFKRAKYLRQKTYIQDIY<br>MKRVDGYLVEGSPDDYTDIKFSVKCAGMTDKIKKE<br>VTFENFKVGFSRKMKPKPVQVPGGVVLVDDTFTIKG<br>HHHHHHHHHH |

Optionally, the recombinant DNA polymerase can include a mutation or combination of mutations selected from: an L253 mutation, where the polymerase further comprises a mutation at one or more of T368, E375, A484, or K512; an E375 and K512 mutation, where the polymerase further comprises a mutation at one or more of L253, T368 or A484; an I93 mutation; an S215 mutation; an E420 mutation; a P477 mutation; a D66R mutation; a K135R mutation; a K138R mutation; an L253T mutation; a Y369G mutation; a Y369L mutation; an L384M mutation; a K422A mutation; an I504R mutation; an E508K mutation; an E508R mutation; a D510K mutation; and a T368 mutation, where the polymerase further comprises a mutation at one or more of E375 or K512 (e.g., a T368 mutation, E375Y, and K512Y, or a T368 mutation, E375Y, A484E and K512Y). Positions are identified relative to wild-type Φ29 DNA polymerase (SEQ ID NO:1). Polymerases that include I93, S215, E420, P477, D66R, K135R, K138R, L253T, Y369G, Y369L, L384M, K422A, I504R, E508K, E508R and/or D510K mutations optionally further include mutations at one or more of L253, T368, E375, A484 or K512.

A polymerase that includes an I93 mutation optionally includes a mutation selected from I93F and I93Y. Polymerases that include an S215 mutation optionally include an S215D mutation. A polymerase that includes an E420 mutation can include an E420M mutation. When the polymerase includes a P477 mutation, the polymerase optionally includes a mutation selected from P477E and P477Q. Additional exemplary substitutions include I378W, I364D, E486K, E486R, I378K, P300E, Y315L, P300G, Y315V, D12R, D12M, D66K, D66R, D66M, P129D, T189D, T203D, S252D, S329D, N330D, F360D, K361D, T427D, T368Y, K361N, W436Y, V514G, P455D, L381E, N387M, I170F, I170R, A176E, A176T, A176V, Q180L, F181P, K182P, Q183D, Q183K, L185D, L185K, A190E, A190F, A190L, A190P, A190T, A190V, G191P, L253E, K361P, D365E, D365P, L381F, L381K, L381R, E508R, E508V, D523F, D523L, D523R, E420R, L384M, K392R, K392M, K392W, K422M, K422W, F137N, T204E, E508R, 511.1G__511.2S, 512.1G__512.2S, 511.1K__511.2S, K512.1G__512.2K, 507.1E__507.2V__507.3D__507.4G__507.5Y, and 511.1E__511.2V__511.3D__511.4G.

Additional exemplary polymerase mutations and/or combinations thereof are provided in FIG. 34, and additional exemplary mutations are described herein. Amino acid substitutions and/or insertions are identified relative to a wild-type Φ29 DNA polymerase (SEQ ID NO:1). Essentially any of these mutations, or any combination thereof, can be introduced into a polymerase to produce a modified recombinant polymerase in accordance with the invention.

Additional exemplary mutation combinations, and optional corresponding exogenous features at the N- and/or C-terminal region of the polymerase, are listed in Table 16. Positions of the mutations are identified relative to a wild-type Φ29 DNA polymerase (SEQ ID NO:1). Polymerases of the invention (including those provided in Table 16) can include any exogenous or heterologous feature (or combination of such features) at the N- and/or C-terminal region. For example, it will be understood that polymerase mutants in Table 16 that do not include, e.g., a C-terminal polyhistidine tag can be modified to include a polyhistidine tag at the C-terminal region, alone or in combination with any of the exogenous or heterologous features described herein. Similarly, some or all of the exogenous features listed in Table 16 can be omitted and still result in a polymerase of the invention.

TABLE 16

| N-terminal features | Mutations | C-terminal feature |
|---|---|---|
| BtagV7co.His10co | L253A_E375Y_A484E_K512Y | CTerm_His10co |
| BtagV7co.His10co | L253A_E375Y_A484E_D510K_K512Y | CTerm_His10co |
| BtagV7co.His10co | Y148I_Y224K_E239G_V250I_L253A_E375Y_A484E_D510K_K512Y | CTerm_His10co |
| BtagV7co.His10co | Y148I_Y224K_E239G_V250I_L253A_E375Y_A484E_D510K_K512Y_E515Q | CTerm_His10co |
| BtagV7co.His10co | E239G_L253A_E375Y_A484E_D510K_K512Y | CTerm_His10co |
| BtagV7co.His10co | Y224K_E239G_L253A_E375Y_A484E_D510K_K512Y | CTerm_His10co |
| BtagV7co.His10co | Y148I_Y224K_E239G_L253C_E375Y_A484E_D510K_K512Y | CTerm_His10co |
| Btag.His10co | N62D_V250I_L253A_E375Y_A484E_K512Y | |
| BtagV7co.His10co | Y224K_E239G_L253A_E375Y_A484E_K512Y_F526L | CTerm_His10co |
| Btagco.His10co | L253A_E375Y_A484E_K512Y_E515K | CTerm_His10co |
| BtagV7co.His10co | E239G_L253A_E375Y_A484E_E508R_K512Y | CTerm_His10co |
| Btagco.His10co | Y148I_L253A_E375Y_A484E_K512Y | CTerm_His10co |
| BtagV7co.His10co | D66R_Y148I_Y224K_E239G_V250I_L253A_E375Y_A484E_D510K_K512Y | CTerm_His10co |
| BtagV7co.His10co | N62D_Y148I_Y224K_E239G_V250I_L253A_E375Y_A484E_D510K_K512Y | CTerm_His10co |
| BtagV7co.His10co | K143R_Y148I_Y224K_E239G_V250I_L253A_E375Y_A484E_D510K_K512Y | CTerm_His10co |
| BtagV7co.His10co | D12N_Y224K_E239G_L253A_E375Y_A484E_K512Y | CTerm_His10co |
| BtagV7co.His10co | Y148F_Y224K_E239G_V250I_L253A_E375Y_A484E_D510K_K512Y | CTerm_His10co |
| BtagV7co.His10co | Y148I_Y224K_E239G_V250I_L253A_E375Y_A484E_D510R_K512Y | CTerm_His10co |
| BtagV7co.His10co | Y148I_Y224K_E239G_V250I_L253A_E375Y_A484E_D510H_K512Y | CTerm_His10co |
| BtagV7co.His10co | Y148I_Y224K_E239G_V250I_L253A_E375Y_A484E_E508K_D510K_K512Y | CTerm_His10co |
| | L253A_E375Y_A484E_K512Y | CTerm_His10co. GGGSGGGSG GGS.BtagV7co |
| | Y148I_Y224K_E239G_V250I_L253A_E375Y_A484E_D510K_K512Y | CTerm_His10co. GGGSGGGSG GGS.BtagV7co |

The amino acid sequences of recombinant Φ29 polymerases harboring the exemplary mutation combinations of Table 16 are provided in Tables 17-19. Table 17 includes the polymerase portion of the molecule as well as the one or more exogenous features at the N- and/or C-terminal region of the polymerase, Table 18 includes the polymerase portion of the molecule and the one or more exogenous features at the C-terminal region of the polymerase, and Table 19 includes the amino acid sequence of the polymerase portion only.

TABLE 17

Amino acid sequences of exemplary recombinant Φ29
polymerases including N- and C-terminal exogenous features.

| | |
|---|---|
| BtagV7co.His10co.CTerm_His10co.-<br>Phi29.-<br>L253A_E375Y_A484E_K512Y.co<br>SEQ ID NO: 133 | msvdglndffeaqkiewheamghhhhhhhhhhssghiegrhmkhmprkmyscdfett<br>tkvedcrvwaygymniedhseykignsldefmawvlkvqadlyfhnlkfdgafiinwlerng<br>fkwsadglpntyntiisrmgqwymidiclgykgkrkihtviydslkklpfpvkkiakdfkltvlkg<br>didyhkerpvgykitpeeyayikndiqiiaealliqfkqgldrmtagsdslkgfkdiitttkkfkkvf<br>ptlslgldkevryayrggftwlndrfkekeigegmvfdvnsaypaqmysrllpygepivfegk<br>yvwdedyplhiqhircefelkegyiptiqikrsrfykgneylkssggeiadlwlsnvdlelmke<br>hydlynveyisglkfkattglfkdfidkwtyikttsygaikqlaklmlnslygkfasnpdvtgkvp<br>ylkengalgfrlgeeetkdpvytpmgvfitawaryttitaaqacydriiycdtdsihltgteipdvi<br>kdivdpkklgywehestfkrakylrqktyiqdiymkevdgylvegspddytdikfsvkcagm<br>tdkikkevtfenfkvgfsrkmkpkpvqvpggvvlvddtftikghhhhhhhhhh |
| BtagV7co.His10co.CTerm_His10co.-<br>Phi29.-<br>L253A_E375Y_A484E_D510K_K512Y.co<br>SEQ ID NO: 134 | msvdglndffeaqkiewheamghhhhhhhhhhssghiegrhmkhmprkmyscdfett<br>tkvedcrvwaygymniedhseykignsldefmawvlkvqadlyfhnlkfdgafiinwlerng<br>fkwsadglpntyntiisrmgqwymidiclgykgkrkihtviydslkklpfpvkkiakdfkltvlkg<br>didyhkerpvgykitpeeyayikndiqiiaealliqfkqgldrmtagsdslkgfkdiitttkkfkkvf<br>ptlslgldkevryayrggftwlndrfkekeigegmvfdvnsaypaqmysrllpygepivfegk<br>yvwdedyplhiqhircefelkegyiptiqikrsrfykgneylkssggeiadlwlsnvdlelmke<br>hydlynveyisglkfkattglfkdfidkwtyikttsygaikqlaklmlnslygkfasnpdvtgkvp<br>ylkengalgfrlgeeetkdpvytpmgvfitawaryttitaaqacydriiycdtdsihltgteipdvi<br>kdivdpkklgywehestfkrakylrqktyiqdiymkevdgylvegspddytdikfsvkcagm<br>tdkikkevtfenfkvgfsrkmkpkpvqvpggvvlvddtftikghhhhhhhhhh |
| BtagV7co.His10co.CTerm_His10co.-<br>Phi29.-Y148I_Y224K_E239G_V250I_<br>L253A_E375Y_A484E_D510K_K512Y.co<br>SEQ ID NO: 135 | msvdglndffeaqkiewheamghhhhhhhhhhssghiegrhmkhmprkmyscdfett<br>tkvedcrvwaygymniedhseykignsldefmawvlkvqadlyfhnlkfdgafiinwlerng<br>fkwsadglpntyntiisrmgqwymidiclgykgkrkihtviydslkklpfpvkkiakdfkltvlkg<br>didihkerpvgykitpeeyayikndiqiiaealliqfkqgldrmtagsdslkgfkdiitttkkfkkvfp<br>tlslgldkevrkayrggftwlndrfkgkeigegmvfdinsaypaqmysrllpygepivfegkyv<br>wdedyplhiqhircefelkegyiptiqikrsrfykgneylkssggeiadlwlsnvdlelmkehy<br>dlynveyisglkfkattglfkdfidkwtyikttsygaikqlaklmlnslygkfasnpdvtgkvpylk<br>engalgfrlgeeetkdpvytpmgvfitawaryttitaaqacydriiycdtdsihltgteipdvikdi<br>vdpkklgywehestfkrakylrqktyiqdiymkevkgylvegspddytdikfsvkcagmtdk<br>ikkevtfenfkvgfsrkmkpkpvqvpggvvlvddtftikghhhhhhhhhh |
| BtagV7co.His10co.CTerm_His10co.-<br>Phi29.Y148I_Y224K_E239G_V250I_<br>L253A_E375Y_A484E_D510K_K512Y_<br>E515Q.co<br>SEQ ID NO: 136 | msvdglndffeaqkiewheamghhhhhhhhhhssghiegrhmkhmprkmyscdfett<br>tkvedcrvwaygymniedhseykignsldefmawvlkvqadlyfhnlkfdgafiinwlerng<br>fkwsadglpntyntiisrmgqwymidiclgykgkrkihtviydslkklpfpvkkiakdfkltvlkg<br>didihkerpvgykitpeeyayikndiqiiaealliqfkqgldrmtagsdslkgfkdiitttkkfkkvfp<br>tlslgldkevrkayrggftwlndrfkgkeigegmvfdinsaypaqmysrllpygepivfegkyv<br>wdedyplhiqhircefelkegyiptiqikrsrfykgneylkssggeiadlwlsnvdlelmkehy<br>dlynveyisglkfkattglfkdfidkwtyikttsygaikqlaklmlnslygkfasnpdvtgkvpylk<br>engalgfrlgeeetkdpvytpmgvfitawaryttitaaqacydriiycdtdsihltgteipdvikdi<br>vdpkklgywehestfkrakylrqktyiqdiymkevkgylvqgspddytdikfsvkcagmtdk<br>ikkevtfenfkvgfsrkmkpkpvqvpggvvlvddtftikghhhhhhhhhh |
| BtagV7co.His10co.CTerm_His10co.-<br>Phi29.E239G_L253A_E375Y_A484E_<br>D510K_K512Y.co<br>SEQ ID NO: 137 | msvdglndffeaqkiewheamghhhhhhhhhhssghiegrhmkhmprkmyscdfett<br>tkvedcrvwaygymniedhseykignsldefmawvlkvqadlyfhnlkfdgafiinwlerng<br>fkwsadglpntyntiisrmgqwymidiclgykgkrkihtviydslkklpfpvkkiakdfkltvlkg<br>didyhkerpvgykitpeeyayikndiqiiaealliqfkqgldrmtagsdslkgfkdiitttkkfkkvf<br>ptlslgldkevryayrggftwlndrfkgkeigegmvfdvnsaypaqmysrllpygepivfegk<br>yvwdedyplhiqhircefelkegyiptiqikrsrfykgneylkssggeiadlwlsnvdlelmke<br>hydlynveyisglkfkattglfkdfidkwtyikttsygaikqlaklmlnslygkfasnpdvtgkvp<br>ylkengalgfrlgeeetkdpvytpmgvfitawaryttitaaqacydriiycdtdsihltgteipdvi<br>kdivdpkklgywehestfkrakylrqktyiqdiymkevdgylvegspddytdikfsvkcagm<br>tdkikkevtfenfkvgfsrkmkpkpvqvpggvvlvddtftikghhhhhhhhhh |
| BtagV7co.His10co.CTerm_His10co.-<br>Phi29.Y224K_E239G_L253A_E375Y_<br>A484E_D510K_K512Y.co<br>SEQ ID NO: 138 | msvdglndffeaqkiewheamghhhhhhhhhhssghiegrhmkhmprkmyscdfett<br>tkvedcrvwaygymniedhseykignsldefmawvlkvqadlyfhnlkfdgafiinwlerng<br>fkwsadglpntyntiisrmgqwymidiclgykgkrkihtviydslkklpfpvkkiakdfkltvlkg<br>didyhkerpvgykitpeeyayikndiqiiaealliqfkqgldrmtagsdslkgfkdiitttkkfkkvf<br>ptlslgldkevrkayrggftwlndrfkgkeigegmvfdvnsaypaqmysrllpygepivfegk<br>yvwdedyplhiqhircefelkegyiptiqikrsrfykgneylkssggeiadlwlsnvdlelmke<br>hydlynveyisglkfkattglfkdfidkwtyikttsygaikqlaklmlnslygkfasnpdvtgkvp<br>ylkengalgfrlgeeetkdpvytpmgvfitawaryttitaaqacydriiycdtdsihltgteipdvi<br>kdivdpkklgywehestfkrakylrqktyiqdiymkevkgylvegspddytdikfsvkcagm<br>tdkikkevtfenfkvgfsrkmkpkpvqvpggvvlvddtftikghhhhhhhhhh |
| BtagV7co.His10co.CTerm_His10co.-<br>Phi29.Y148I_Y224K_E239G_L253C_<br>E375Y_A484E_D510K_K512Y.co<br>SEQ ID NO: 139 | msvdglndffeaqkiewheamghhhhhhhhhhssghiegrhmkhmprkmyscdfett<br>tkvedcrvwaygymniedhseykignsldefmawvlkvqadlyfhnlkfdgafiinwlerng<br>fkwsadglpntyntiisrmgqwymidiclgykgkrkihtviydslkklpfpvkkiakdfkltvlkg<br>didihkerpvgykitpeeyayikndiqiiaealliqfkqgldrmtagsdslkgfkdiitttkkfkkvfp<br>tlslgldkevrkayrggftwlndrfkgkeigegmvfdvnscypaqmysrllpygepivfegky<br>vwdedyplhiqhircefelkegyiptiqiklrsrfykgneylkssggeiadlwlsnvdlelmkeh<br>ydlynveyisglkfkattglfkdfidkwtyikttsygaikqlaklmlnslygkfasnpdvtgkvpyl<br>kengalgfrlgeeetkdpvytpmgvfitawaryttitaaqacydriiycdtdsihltgteipdvikd<br>ivdpkklgywehestfkrakylrqktyiqdiymkevkgylvegspddytdikfsvkcagmtd<br>kikkevtfenfkvgfsrkmkpkpvqvpggvvlvddtftikghhhhhhhhhh |

TABLE 17-continued

Amino acid sequences of exemplary recombinant Φ29
polymerases including N- and C-terminal exogenous features.

| Name | Sequence |
|---|---|
| Btag.His10co.-<br>N62D_V250I_L253A_E375Y_<br>A484E_K512Y.co<br>SEQ ID NO: 140 | msvdglndifeaqkiewheamghhhhhhhhhhssghiegrhmkhmprkmyscdfett<br>tkvedcrvwaygymniedhseykignsldefmawvlkvqadlyfhnlkfdgafiinwlerng<br>fkwsadglpntyntiisrmgqwymidiclgykgkrkihtviydslkklpfpvkkiakdfkltvlkg<br>didyhkerpvgykitpeeyayikndiqiiaealliqfkqgldrmtagsdslkgfkdiittkkfkkvf<br>ptlslgldkevryayrggftwlndrfkekeigegmvfdinsaypaqmysrllpygepivfegky<br>vwdedyplhiqhircefelkegyiptiqikrsrfykgneylkssggeiadlwlsnvdlelmkeh<br>ydlynveyisglkfkattglfkdfidkwtyikttsygaikqlaklmlnslygkfasnpdvtgkvpyl<br>kengalgfrlgeeetkdpvytpmgvfitawaryttitaaqacydriiycdtdsihltgteipdvikd<br>ivdpkklgywehestfkrakylrqktyiqdiymkevdgylvegspddytdikfsvkcagmtd<br>kikkevtfenfkvgfsrkmkpkpvqvpggvvlvddtftik |
| BtagV7co.His10co.CTerm_His10co.-<br>Phi29.Y224K_E239G_L253A_E375Y_<br>A484E_K512Y_F526L.co<br>SEQ ID NO: 141 | msvdglndffeaqkiewheamghhhhhhhhhhssghiegrhmkhmprkmyscdfett<br>tkvedcrvwaygymniedhseykignsldefmawvlkvqadlyfhnlkfdgafiinwlerng<br>fkwsadglpntyntiisrmgqwymidiclgykgkrkihtviydslkklpfpvkkiakdfkltvlkg<br>didyhkerpvgykitpeeyayikndiqiiaealliqfkqgldrmtagsdslkgfkdiittkkfkkvf<br>ptlslgldkevrkayrggftwlndrfkgkeigegmvfdvnsaypaqmysrllpygepivfegk<br>yvwdedyplhiqhircefelkegyiptiqikrsrfykgneylkssggeiadlwlsnvdlelmke<br>hydlynveyisglkfkattglfkdfidkwtyikttsygaikqlaklmlnslygkfasnpdvtgkvp<br>ylkengalgfrlgeeetkdpvytpmgvfitawaryttitaaqacydriiycdtdsihltgteipdvi<br>kdivdpkklgywehestfkrakylrqktyiqdiymkevdgylvegspddytdiklsvkcagm<br>tdkikkevtfenfkvgfsrkmkpkpvqvpggvvlvddtftikghhhhhhhhhh |
| Btagco.His10co.CTerm_His10co.-<br>Phi29.L253A_E375Y_A484E_<br>K512Y_E515K.co<br>SEQ ID NO: 142 | msvdglndifeaqkiewheamghhhhhhhhhhssghiegrhmkhmprkmyscdfett<br>tkvedcrvwaygymniedhseykignsldefmawvlkvqadlyfhnlkfdgafiinwlerng<br>fkwsadglpntyntiisrmgqwymidiclgykgkrkihtviydslkklpfpvkkiakdfkltvlkg<br>didyhkerpvgykitpeeyayikndiqiiaealliqfkqgldrmtagsdslkgfkdiittkkfkkvf<br>ptlslgldkevryayrggftwlndrfkekeigegmvfdvnsaypaqmysrllpygepivfegk<br>yvwdedyplhiqhircefelkegyiptiqikrsrfykgneylkssggeiadlwlsnvdlelmke<br>hydlynveyisglkfkattglfkdfidkwtyikttsygaikqlaklmlnslygkfasnpdvtgkvp<br>ylkengalgfrlgeeetkdpvytpmgvfitawaryttitaaqacydriiycdtdsihltgteipdvi<br>kdivdpkklgywehestfkrakylrqktyiqdiymkevdgylvkgspddytdikfsvkcagm<br>tdkikkevtfenfkvgfsrkmkpkpvqvpggvvlvddtftikghhhhhhhhhh |
| BtagV7co.His10co.CTerm_His10co.-<br>Phi29.E239G_L253A_E375Y_A484E_<br>E508R_K512Y.co<br>SEQ ID NO: 143 | msvdglndffeaqkiewheamghhhhhhhhhhssghiegrhmkhmprkmyscdfett<br>tkvedcrvwaygymniedhseykignsldefmawvlkvqadlyfhnlkfdgafiinwlerng<br>fkwsadglpntyntiisrmgqwymidiclgykgkrkihtviydslkklpfpvkkiakdfkltvlkg<br>didyhkerpvgykitpeeyayikndiqiiaealliqfkqgldrmtagsdslkgfkdiittkkfkkvf<br>ptlslgldkevryayrggftwlndrfkgkeigegmvfdvnsaypaqmysrllpygepivfegk<br>yvwdedyplhiqhircefelkegyiptiqikrsrfykgneylkssggeiadlwlsnvdlelmke<br>hydlynveyisglkfkattglfkdfidkwtyikttsygaikqlaklmlnslygkfasnpdvtgkvp<br>ylkengalgfrlgeeetkdpvytpmgvfitawaryttitaaqacydriiycdtdsihltgteipdvi<br>kdivdpkklgywehestfkrakylrqktyiqdiymkrvdgylvegspddytdikfsvkcagmt<br>dkikkevtfenfkvgfsrkmkpkpvqvpggvvlvddtftikghhhhhhhhhh |
| Btagco.His10co.CTerm_His10co.-<br>Phi29.Y148I_L253A_E375Y_<br>A484E_K512Y.co<br>SEQ ID NO: 144 | msvdglndifeaqkiewheamghhhhhhhhhhssghiegrhmkhmprkmyscdfett<br>tkvedcrvwaygymniedhseykignsldefmawvlkvqadlyfhnlkfdgafiinwlerng<br>fkwsadglpntyntiisrmgqwymidiclgykgkrkihtviydslkklpfpvkkiakdfkltvlkg<br>didihkerpvgykitpeeyayikndiqiiaealliqfkqgldrmtagsdslkgfkdiittkkfkkvfp<br>tlslgldkevryayrggftwlndrfkekeigegmvfdvnsaypaqmysrllpygepivfegky<br>vwdedyplhiqhircefelkegyiptiqikrsrfykgneylkssggeiadlwlsnvdlelmkeh<br>ydlynveyisglkfkattglfkdfidkwtyikttsygaikqlaklmlnslygkfasnpdvtgkvpyl<br>kengalgfrlgeeetkdpvytpmgvfitawaryttitaaqacydriiycdtdsihltgteipdvikd<br>ivdpkklgywehestfkrakylrqktyiqdiymkevdgylvegspddytdikfsvkcagmtd<br>kikkevtfenfkvgfsrkmkpkpvqvpggvvlvddtftikghhhhhhhhhh |
| BtagV7co.His10co.CTerm_His10co.-<br>Phi29.D66R_Y148I_Y224K_E239G_<br>V250I_L253A_E375Y_A484E_D510K_<br>K512Y.co<br>SEQ ID NO: 145 | msvdglndffeaqkiewheamghhhhhhhhhhssghiegrhmkhmprkmyscdfett<br>tkvedcrvwaygymniedhseykignsldefmawvlkvqadlyfhnlkfrgafiinwlerngf<br>kwsadglpntyntiisrmgqwymidiclgykgkrkihtviydslkklpfpvkkiakdfkltvlkgd<br>idihkerpvgykitpeeyayikndiqiiaealliqfkqgldrmtagsdslkgfkdiittkkfkkvfptl<br>slgldkevrkayrggftwlndrfkgkeigegmvfdinsaypaqmysrllpygepivfegkyv<br>wdedyplhiqhircefelkegyiptiqikrsrfykgneylkssggeiadlwlsnvdlelmkehy<br>dlynveyisglkfkattglfkdfidkwtyikttsygaikqlaklmlnslygkfasnpdvtgkvpylk<br>engalgfrlgeeetkdpvytpmgvfitawaryttitaaqacydriiycdtdsihltgteipdvikdi<br>vdpkklgywehestfkrakylrqktyiqdiymkevgylvegspddytdikfsvkcagmtdk<br>ikkevtfenfkvgfsrkmkpkpvqvpggvvlvddtftikghhhhhhhhhh |
| BtagV7co.His10co.CTerm_His10co.-<br>Phi29.N62D_Y148I_Y224K_E239G_<br>V250I_L253A_E375Y_A484E_D510K_<br>K512Y.co<br>SEQ ID NO: 146 | msvdglndffeaqkiewheamghhhhhhhhhhssghiegrhmkhmprkmyscdfett<br>tkvedcrvwaygymniedhseykignsldefmawvlkvqadlyfhnlkfdgafiinwlerng<br>fkwsadglpntyntiisrmgqwymidiclgykgkrkihtviydslkklpfpvkkiakdfkltvlkg<br>didihkerpvgykitpeeyayikndiqiiaealliqfkqgldrmtagsdslkgfkdiittkkfkkvfp<br>tlslgldkevrkayrggftwlndrfkgkeigegmvfdinsaypaqmysrllpygepivfegkyv<br>wdedyplhiqhircefelkegyiptiqikrsrfykgneylkssggeiadlwlsnvdlelmkehy<br>dlynveyisglkfkattglfkdfidkwtyikttsygaikqlaklmlnslygkfasnpdvtgkvpylk<br>engalgfrlgeeetkdpvytpmgvfitawaryttitaaqacydriiycdtdsihltgteipdvikdi<br>vdpkklgywehestfkrakylrqktyiqdiymkevgylvegspddytdikfsvkcagmtdk<br>ikkevtfenfkvgfsrkmkpkpvqvpggvvlvddtftikghhhhhhhhhh |

TABLE 17-continued

Amino acid sequences of exemplary recombinant Φ29
polymerases including N- and C-terminal exogenous features.

| | |
|---|---|
| BtagV7co.His10co.CTerm_His10co.-<br>Phi29.K143R_Y148Y_Y224K_E239G_<br>V250I_L253A_E375Y_A484E_D510K_<br>K512Y.co<br>SEQ ID NO: 147 | msvdglndffeaqkiewheamghhhhhhhhhhssghiegrhmkhmprkmyscdfett<br>tkvedcrvwaygymniedhseykignsldefmawvlkvqadlyfhnlkfdgafiinwlerng<br>fkwsadglpntyntiisrmgqwymidiclgykgkrkihtviydslkklpfpvkkiakdfkltvlrg<br>dididihkerpvgykitpeeyayikndiqiiaealliqfkqgldrmtagsdslkgfkdiitttkkfkkvfp<br>tlslgldkevrkayrggftwlndrfkgkeigegmvfdinsaypaqmysrllpygepivfegkyv<br>wdedyplhiqhircefelkegyiptiqikrsrfykgneylkssggeiadlwlsnvdlelmkehy<br>dlynveyisglkfkattglfkdfidkwtyiktttsygaikqlaklmlnslygkfasnpdvtgkvpylk<br>engalgfrlgeeetkdpvytpmgvfitawaryttitaaqacydriiycdtdsihltgteipdvikdi<br>vdpkklgywehestfkrakylrqktyiqdiymkevkgylvegspddytdikfsvkcagmtdk<br>ikkevtfenfkvgfsrkmkpkpvqvpggvvlvddtftikghhhhhhhhhh |
| BtagV7co.His10co.CTerm_His10co.-<br>Phi29.D12N_Y224K_E239G_L253A_<br>E375Y_A484E_K512Y.co<br>SEQ ID NO: 148 | msvdglndffeaqkiewheamghhhhhhhhhhssghiegrhmkhmprkmyscnfett<br>tkvedcrvwaygymniedhseykignsldefmawvlkvqadlyfhnlkfdgafiinwlerng<br>fkwsadglpntyntiisrmgqwymidiclgykgkrkihtviydslkklpfpvkkiakdfkltvlkg<br>didyhkerpvgykitpeeyayikndiqiiaealliqfkqgldrmtagsdslkgfkdiitttkkfkkvf<br>ptlslgldkevrkayrggftwlndrfkgkeigegmvfdvnsaypaqmysrllpygepivfegk<br>yvwdedyplhiqhircefelkegyiptiqikrsrfykgneylkssggeiadlwlsnvdlelmke<br>hydlynveyisglkfkattglfkdfidkwtyiktttsygaikqlaklmlnslygkfasnpdvtgkvp<br>ylkengalgfrlgeeetkdpvytpmgvfitawaryttitaaqacydriiycdtdsihltgteipdvi<br>kdivdpkklgywehestfkrakylrqktyiqdiymkevkgylvegspddytdikfsvkcagm<br>tdkikkevtfenfkvgfsrkmkpkpvqvpggvvlvddtftikghhhhhhhhhh |
| BtagV7co.His10co.CTerm_His10co.-<br>Phi29.Y148F_Y224K_E239G_V250I_<br>L253A_E375Y_A484E_D510K_<br>K512Y.co<br>SEQ ID NO: 149 | msvdglndffeaqkiewheamghhhhhhhhhhssghiegrhmkhmprkmyscdfett<br>tkvedcrvwaygymniedhseykignsldefmawvlkvqadlyfhnlkfdgafiinwlerng<br>fkwsadglpntyntiisrmgqwymidiclgykgkrkihtviydslkklpfpvkkiakdfkltvlkg<br>didfhkerpvgykitpeeyayikndiqiiaealliqfkqgldrmtagsdslkgfkdiitttkkfkkvfp<br>tlslgldkevrkayrggftwlndrfkgkeigegmvfdinsaypaqmysrllpygepivfegkyv<br>wdedyplhiqhircefelkegyiptiqikrsrfykgneylkssggeiadlwlsnvdlelmkehy<br>dlynveyisglkfkattglfkdfidkwtyiktttsygaikqlaklmlnslygkfasnpdvtgkvpylk<br>engalgfrlgeeetkdpvytpmgvfitawaryttitaaqacydriiycdtdsihltgteipdvikdi<br>vdpkklgywehestfkrakylrqktyiqdiymkevkgylvegspddytdikfsvkcagmtdk<br>ikkevtfenfkvgfsrkmkpkpvqvpggvvlvddtftikghhhhhhhhhh |
| BtagV7co.His10co.CTerm_His10co.-<br>Phi29.Y148I_Y224K_E239G_<br>V250I_L253A_E375Y_A484E_<br>D510R_K512Y.co<br>SEQ ID NO: 150 | msvdglndffeaqkiewheamghhhhhhhhhhssghiegrhmkhmprkmyscdfett<br>tkvedcrvwaygymniedhseykignsldefmawvlkvqadlyfhnlkfdgafiinwlerng<br>fkwsadglpntyntiisrmgqwymidiclgykgkrkihtviydslkklpfpvkkiakdfkltvlkg<br>didihkerpvgykitpeeyayikndiqiiaealliqfkqgldrmtagsdslkgfkdiitttkkfkkvfp<br>tlslgldkevrkayrggftwlndrfkgkeigegmvfdinsaypaqmysrllpygepivfegkyv<br>wdedyplhiqhircefelkegyiptiqikrsrfykgneylkssggeiadlwlsnvdlelmkehy<br>dlynveyisglkfkattglfkdfidkwtyiktttsygaikqlaklmlnslygkfasnpdvtgkvpylk<br>engalgfrlgeeetkdpvytpmgvfitawaryttitaaqacydriiycdtdsihltgteipdvikdi<br>vdpkklgywehestfkrakylrqktyiqdiymkevrgylvegspddytdikfsvkcagmtdki<br>kkevtfenfkvgfsrkmkpkpvqvpggvvlvddtftikghhhhhhhhhh |
| BtagV7co.His10co.CTerm_His10co.-<br>Phi29.Y148I_Y224K_E239G_V250I_<br>L253A_E375Y_A484E_D510H_K512Y.co<br>SEQ ID NO: 151 | msvdglndffeaqkiewheamghhhhhhhhhhssghiegrhmkhmprkmyscdfett<br>tkvedcrvwaygymniedhseykignsldefmawvlkvqadlyfhnlkfdgafiinwlerng<br>fkwsadglpntyntiisrmgqwymidiclgykgkrkihtviydslkklpfpvkkiakdfkltvlkg<br>didihkerpvgykitpeeyayikndiqiiaealliqfkqgldrmtagsdslkgfkdiitttkkfkkvfp<br>tlslgldkevrkayrggftwlndrfkgkeigegmvfdinsaypaqmysrllpygepivfegkyv<br>wdedyplhiqhircefelkegyiptiqikrsrfykgneylkssggeiadlwlsnvdlelmkehy<br>dlynveyisglkfkattglfkdfidkwtyiktttsygaikqlaklmlnslygkfasnpdvtgkvpylk<br>engalgfrlgeeetkdpvytpmgvfitawaryttitaaqacydriiycdtdsihltgteipdvikdi<br>vdpkklgywehestfkrakylrqktyiqdiymkevhgylvegspddytdikfsvkcagmtdk<br>ikkevtfenfkvgfsrkmkpkpvqvpggvvlvddtftikghhhhhhhhhh |
| BtagV7co.His10co.CTerm_His10co.-<br>Phi29.Y148I_Y224K_E239G_V250I_<br>L253A_E375Y_A484E_E508K_<br>D510K_K512Y.co<br>SEQ ID NO: 152 | msvdglndffeaqkiewheamghhhhhhhhhhssghiegrhmkhmprkmyscdfett<br>tkvedcrvwaygymniedhseykignsldefmawvlkvqadlyfhnlkfdgafiinwlerng<br>fkwsadglpntyntiisrmgqwymidiclgykgkrkihtviydslkklpfpvkkiakdfkltvlkg<br>didihkerpvgykitpeeyayikndiqiiaealliqfkqgldrmtagsdslkgfkdiitttkkfkkvfp<br>tlslgldkevrkayrggftwlndrfkgkeigegmvfdinsaypaqmysrllpygepivfegkyv<br>wdedyplhiqhircefelkegyiptiqikrsrfykgneylkssggeiadlwlsnvdlelmkehy<br>dlynveyisglkfkattglfkdfidkwtyiktttsygaikqlaklmlnslygkfasnpdvtgkvpylk<br>engalgfrlgeeetkdpvytpmgvfitawaryttitaaqacydriiycdtdsihltgteipdvikdi<br>vdpkklgywehestfkrakylrqktyiqdiymkkvkgylvegspddytdikfsvkcagmtdki<br>kkevtfenfkvgfsrkmkpkpvqvpggvvlvddtftikghhhhhhhhhh |
| CTerm_His10co.GGGSGGGSGGGS.-<br>BtagV7co.Phi29.L253A_E375Y_<br>A484E_K512Y.co<br>SEQ ID NO: 192 | mkhmprkmyscdfetttkvedcrvwaygymniedhseykignsldefmawvlkvqadl<br>yfhnlkfdgafiinwlerngfkwsadglpntyntiisrmgqwymidiclgykgkrkihtviydslk<br>klpfpvkkiakdfkltvlkgdidyhkerpvgykitpeeyayikndiqiiaealliqfkqgldrmtag<br>sdslkgfkdiitttkkfkkvfptlslgldkevryayrggftwlndrfkekeigegmvfdvnsaypaq<br>mysrllpygepivfegkyvwdedyplhiqhircefelkegyiptiqikrsrfykgneylkssgge<br>iadlwlsnvdlelmkehydlynveyisglkfkattglfkdfidkwtyiktttsygaikqlaklmlnsl<br>ygkfasnpdvtgkvpylkengalgfrlgeeetkdpvytpmgvfitawaryttitaaqacydriiy<br>cdtdsihltgteipdvikdivdpkklgywehestfkrakylrqktyiqdiymkevkgylvegsp<br>ddytdikfsvkcagmtdkikkevtfenfkvgfsrkmkpkpvqvpggvvlvddtftikghhhh<br>hhhhhhgggsgggsgggsglndffeaqkiewhe |

TABLE 17-continued

Amino acid sequences of exemplary recombinant Φ29
polymerases including N- and C-terminal exogenous features.

| | |
|---|---|
| CTerm_His10co.GGGSGGGSGGGS.-<br>BtagV7co.Phi29.Y148I_Y224K_<br>E239G_V250I_L253A_<br>E375Y_A484E_D510K_<br>K512Y.co<br>SEQ ID NO: 193 | mkhmprkmyscdfetttkvedcrvwaygymniedhseykignsldefmawvlkvqadl<br>yfhnlkfdgafiinwlerngfkwsadglpntyntiisrmgqwymidiclgykgkrkihtviydslk<br>klpfpvkkiakdfkltvlkgdidihkerpvgykitpeeyayikndiqiiaealliqfkqgldrmtag<br>sdslkgfkdiitttkkfkkvfptlslgldkevrkayrggftwlndrfkgkeigegmvfdinsaypaq<br>mysrllpygepivfegkyvwdedyplhiqhircefelkegyiptiqikrsrfykgneylkssgge<br>iadlwlsnvdlelmkehydlynveyisglkfkattglfkdfidkwtyikttsygaikqlaklmlnsl<br>ygkfasnpdvtgkvpylkengalgfrlgeeetkdpvytpmgvfitawaryttitaaqacydriiy<br>cdtdsihltgteipdvikdivdpkklgywehestfkrakylrqktyiqdiymkevkgylvegsp<br>ddytdikfsvkcagmtdkikkevtfenfkvgfsrkmkpkpvqvpggvvlvddtftikghhhh<br>hhhhhhgggsgggsgggsglndffeaqkiewhe |

TABLE 18

Amino acid sequences of exemplary recombinant Φ29
polymerases including C-terminal exogenous features.

| | |
|---|---|
| CTerm_His10co.Phi29.-<br>L253A_E375Y_A484E_K512Y.co<br>SEQ ID NO: 153 | mkhmprkmyscdfetttkvedcrvwaygymniedhseykignsldefmawvlkvqadl<br>yfhnlkfdgafiinwlerngfkwsadglpntyntiisrmgqwymidiclgykgkrkihtviydsl<br>kklpfpvkkiakdfkltvlkgdidyhkerpvgykitpeeyayikndiqiiaealliqfkqgldrmt<br>agsdslkgfkdiitttkkfkkvfptlslgldkevryayrggftwlndrfkekeigegmvfdvnsay<br>paqmysrllpygepivfegkyvwdedyplhiqhircefelkegyiptiqikrsrfykgneylks<br>sggeiadlwlsnvdlelmkehydlynveyisglkfkattglfkdfidkwtyikttsygaikqlakl<br>mlnslygkfasnpdvtgkvpylkengalgfrlgeeetkdpvytpmgvfitawaryttitaaqa<br>cydriiycdtdsihltgteipdvikdivdpkklgywehestfkrakylrqktyiqdiymkevdgy<br>lvegspddytdikfsvkcagmtdkikkevtfenfkvgfsrkmkpkpvqvpggvvlvddtfti<br>kghhhhhhhhhh |
| CTerm_His10co.Phi29.-<br>L253A_E375Y_A484E_D510K_K512Y.co<br>SEQ ID NO: 154 | mkhmprkmyscdfetttkvedcrvwaygymniedhseykignsldefmawvlkvqadl<br>yfhnlkfdgafiinwlerngfkwsadglpntyntiisrmgqwymidiclgykgkrkihtviydsl<br>kklpfpvkkiakdfkltvlkgdidyhkerpvgykitpeeyayikndiqiiaealliqfkqgldrmt<br>agsdslkgfkdiitttkkfkkvfptlslgldkevryayrggftwlndrfkekeigegmvfdvnsay<br>paqmysrllpygepivfegkyvwdedyplhiqhircefelkegyiptiqikrsrfykgneylks<br>sggeiadlwlsnvdlelmkehydlynveyisglkfkattglfkdfidkwtyikttsygaikqlakl<br>mlnslygkfasnpdvtgkvpylkengalgfrlgeeetkdpvytpmgvfitawaryttitaaqa<br>cydriiycdtdsihltgteipdvikdivdpkklgywehestfkrakylrqktyiqdiymkevkgy<br>lvegspddytdikfsvkcagmtdkikkevtfenfkvgfsrkmkpkpvqvpggvvlvddtfti<br>kghhhhhhhhhh |
| CTerm_His10co.Phi29.-<br>Y148I_Y224K_E239G_V250I_L253A_E375Y_<br>A484E_D510K_K512Y.co<br>SEQ ID NO: 155 | mkhmprkmyscdfetttkvedcrvwaygymniedhseykignsldefmawvlkvqadl<br>yfhnlkfdgafiinwlerngfkwsadglpntyntiisrmgqwymidiclgykgkrkihtviydsl<br>kklpfpvkkiakdfkltvlkgdidihkerpvgykitpeeyayikndiqiiaealliqfkqgldrmta<br>gsdslkgfkdiitttkkfkkvfptlslgldkevrkayrggftwlndrfkgkeigegmvfdinsayp<br>aqmysrllpygepivfegkyvwdedyplhiqhircefelkegyiptiqikrsrfykgneylkss<br>ggeiadlwlsnvdlelmkehydlynveyisglkfkattglfkdfidkwtyikttsygaikqlakl<br>mlnslygkfasnpdvtgkvpylkengalgfrlgeeetkdpvytpmgvfitawaryttitaaqa<br>cydriiycdtdsihltgteipdvikdivdpkklgywehestfkrakylrqktyiqdiymkevkgy<br>lvegspddytdikfsvkcagmtdkikkevtfenfkvgfsrkmkpkpvqvpggvvlvddtfti<br>kghhhhhhhhhh |
| CTerm_His10co.Phi29.-<br>Y148I_Y224K_E239G_V250I_L253A_E375Y_<br>A484E_D510K_K512Y_E515Q.co<br>SEQ ID NO: 156 | mkhmprkmyscdfetttkvedcrvwaygymniedhseykignsldefmawvlkvqadl<br>yfhnlkfdgafiinwlerngfkwsadglpntyntiisrmgqwymidiclgykgkrkihtviydsl<br>kklpfpvkkiakdfkltvlkgdidihkerpvgykitpeeyayikndiqiiaealliqfkqgldrmta<br>gsdslkgfkdiitttkkfkkvfptlslgldkevrkayrggftwlndrfkgkeigegmvfdinsayp<br>aqmysrllpygepivfegkyvwdedyplhiqhircefelkegyiptiqikrsrfykgneylkss<br>ggeiadlwlsnvdlelmkehydlynveyisglkfkattglfkdfidkwtyikttsygaikqlakl<br>mlnslygkfasnpdvtgkvpylkengalgfrlgeeetkdpvytpmgvfitawaryttitaaqa<br>cydriiycdtdsihltgteipdvikdivdpkklgywehestfkrakylrqktyiqdiymkevkgy<br>lvqgspddytdikfsvkcagmtdkikkevtfenfkvgfsrkmkpkpvqvpggvvlvddtfti<br>kghhhhhhhhhh |
| CTerm_His10co.Phi29.-<br>E239G_L253A_E375Y_A484E_D510K_<br>K512Y.co<br>SEQ ID NO: 157 | mkhmprkmyscdfetttkvedcrvwaygymniedhseykignsldefmawvlkvqadl<br>yfhnlkfdgafiinwlerngfkwsadglpntyntiisrmgqwymidiclgykgkrkihtviydsl<br>kklpfpvkkiakdfkltvlkgdidyhkerpvgykitpeeyayikndiqiiaealliqfkqgldrmt<br>agsdslkgfkdiitttkkfkkvfptlslgldkevryayrggftwlndrfkgkeigegmvfdvnsay<br>paqmysrllpygepivfegkyvwdedyplhiqhircefelkegyiptiqikrsrfykgneylks<br>sggeiadlwlsnvdlelmkehydlynveyisglkfkattglfkdfidkwtyikttsygaikqlakl<br>mlnslygkfasnpdvtgkvpylkengalgfrlgeeetkdpvytpmgvfitawaryttitaaqa<br>cydriiycdtdsihltgteipdvikdivdpkklgywehestfkrakylrqktyiqdiymkevkgy<br>lvegspddytdikfsvkcagmtdkikkevtfenfkvgfsrkmkpkpvqvpggvvlvddtfti<br>kghhhhhhhhhh |

TABLE 18-continued

Amino acid sequences of exemplary recombinant Φ29
polymerases including C-terminal exogenous features.

| | |
|---|---|
| CTerm_His10co.Phi29.-<br>Y224K_E239G_L253A_E375Y_A484E_<br>D510K_K512Y.co<br>SEQ ID NO: 158 | mkhmprkmyscdfetttkvedcrvwaygymniedhseykignsldefmawvlkvqadl<br>yfhnlkfdgafiinwlerngfkwsadglpntyntiisrmgqwymidiclgykgkrkihtviydsl<br>kklpfpvkkiakdfkltvlkgdidyhkerpvgykitpeeyayikndiqiiaealliqfkqgldrmt<br>agsdslkgfkdiitttkkfkkvfptlslgldkevrkayrggftwlndrfkgkeigegmvfdvnsay<br>paqmysrllpygepivfegkyvwdedyplhiqhircefelkegyiptiqikrsrfykgneylks<br>sggeiadlwlsnvdlelmkehydlynveyisglkfkattglfkdfidkwtyikttsygaikqlakl<br>mlnslygkfasnpdvtgkvpylkengalgfrlgeeetkdpvytpmgvfitawaryttitaaqa<br>cydriiycdtdsihltgteipdvikdivdpkklgywehestfkrakylrqktyiqdiymkevkgy<br>lvegspddytdikfsvkcagmtdkikkevtfenfkvgfsrkmkpkpvqvpggvvlvddtfti<br>kghhhhhhhhhh |
| CTerm_His10co.Phi29.-<br>Y148I_Y224K_E239G_L253C_<br>E375Y_A484E_D510K_K512Y.co<br>SEQ ID NO: 159 | mkhmprkmyscdfetttkvedcrvwaygymniedhseykignsldefmawvlkvqadl<br>yfhnlkfdgafiinwlerngfkwsadglpntyntiisrmgqwymidiclgykgkrkihtviydsl<br>kklpfpvkkiakdfkltvlkgdidihkerpvgykitpeeyayikndiqiiaealliqfkqgldrmt<br>gsdslkgfkdiitttkkfkkvfptlslgldkevrkayrggftwlndrfkgkeigegmvfdvnscyp<br>aqmysrllpygepivfegkyvwdedyplhiqhircefelkegyiptiqikrsrfykgneylkss<br>ggeiadlwlsnvdlelmkehydlynveyisglkfkattglfkdfidkwtyikttsygaikqlakl<br>mlnslygkfasnpdvtgkvpylkengalgfrlgeeetkdpvytpmgvfitawaryttitaaqa<br>cydriiycdtdsihltgteipdvikdivdpkklgywehestfkrakylrqktyiqdiymkevkgy<br>lvegspddytdikfsvkcagmtdkikkevtfenfkvgfsrkmkpkpvqvpggvvlvddtfti<br>kghhhhhhhhhh |
| CTerm_His10co.Phi29.-<br>Y224K_E239G_L253A_E375Y_A484E_<br>K512Y_F526L.co<br>SEQ ID NO: 160 | mkhmprkmyscdfetttkvedcrvwaygymniedhseykignsldefmawvlkvqadl<br>yfhnlkfdgafiinwlerngfkwsadglpntyntiisrmgqwymidiclgykgkrkihtviydsl<br>kklpfpvkkiakdfkltvlkgdidyhkerpvgykitpeeyayikndiqiiaealliqfkqgldrmt<br>agsdslkgfkdiitttkkfkkvfptlslgldkevrkayrggftwlndrfkgkeigegmvfdvnsay<br>paqmysrllpygepivfegkyvwdedyplhiqhircefelkegyiptiqikrsrfykgneylks<br>sggeiadlwlsnvdlelmkehydlynveyisglkfkattglfkdfidkwtyikttsygaikqlakl<br>mlnslygkfasnpdvtgkvpylkengalgfrlgeeetkdpvytpmgvfitawaryttitaaqa<br>cydriiycdtdsihltgteipdvikdivdpkklgywehestfkrakylrqktyiqdiymkevdgy<br>lvegspddytdiklsvkcagmtdkikkevtfenfkvgfsrkmkpkpvqvpggvvlvddtftik<br>ghhhhhhhhhh |
| CTerm_His10co.Phi29.-<br>L253A_E375Y_A484E_K512Y_E515K.co<br>SEQ ID NO: 161 | mkhmprkmyscdfetttkvedcrvwaygymniedhseykignsldefmawvlkvqadl<br>yfhnlkfdgafiinwlerngfkwsadglpntyntiisrmgqwymidiclgykgkrkihtviydsl<br>kklpfpvkkiakdfkltvlkgdidyhkerpvgykitpeeyayikndiqiiaealliqfkqgldrmt<br>agsdslkgfkdiitttkkfkkvfptlslgldkevryayrggftwlndrfkekeigegmvfdvnsay<br>paqmysrllpygepivfegkyvwdedyplhiqhircefelkegyiptiqikrsrfykgneylks<br>sggeiadlwlsnvdlelmkehydlynveyisglkfkattglfkdfidkwtyikttsygaikqlakl<br>mlnslygkfasnpdvtgkvpylkengalgfrlgeeetkdpvytpmgvfitawaryttitaaqa<br>cydriiycdtdsihltgteipdvikdivdpkklgywehestfkrakylrqktyiqdiymkevdgy<br>lvkgspddytdikfsvkcagmtdkikkevtfenfkvgfsrkmkpkpvqvpggvvlvddtftik<br>ghhhhhhhhhh |
| CTerm_His10co.Phi29.-<br>E239G_L253A_E375Y_A484E_E508R_<br>K512Y.co<br>SEQ ID NO: 162 | mkhmprkmyscdfetttkvedcrvwaygymniedhseykignsldefmawvlkvqadl<br>yfhnlkfdgafiinwlerngfkwsadglpntyntiisrmgqwymidiclgykgkrkihtviydsl<br>kklpfpvkkiakdfkltvlkgdidyhkerpvgykitpeeyayikndiqiiaealliqfkqgldrmt<br>agsdslkgfkdiitttkkfkkvfptlslgldkevryayrggftwlndrfkgkeigegmvfdvnsay<br>paqmysrllpygepivfegkyvwdedyplhiqhircefelkegyiptiqikrsrfykgneylks<br>sggeiadlwlsnvdlelmkehydlynveyisglkfkattglfkdfidkwtyikttsygaikqlakl<br>mlnslygkfasnpdvtgkvpylkengalgfrlgeeetkdpvytpmgvfitawaryttitaaqa<br>cydriiycdtdsihltgteipdvikdivdpkklgywehestfkrakylrqktyiqdiymkrvdgyl<br>vegspddytdikfsvkcagmtdkikkevtfenfkvgfsrkmkpkpvqvpggvvlvddtftik<br>ghhhhhhhhhh |
| CTerm_His10co.Phi29.-<br>Y148I_L253A_E375Y_A484E_K512Y.co<br>SEQ ID NO: 163 | mkhmprkmyscdfetttkvedcrvwaygymniedhseykignsldefmawvlkvqadl<br>yfhnlkfdgafiinwlerngfkwsadglpntyntiisrmgqwymidiclgykgkrkihtviydsl<br>kklpfpvkkiakdfkltvlkgdidihkerpvgykitpeeyayikndiqiiaealliqfkqgldrmta<br>gsdslkgfkdiitttkkfkkvfptlslgldkevryayrggftwlndrfkekeigegmvfdvnsayp<br>aqmysrllpygepivfegkyvwdedyplhiqhircefelkegyiptiqikrsrfykgneylkss<br>ggeiadlwlsnvdlelmkehydlynveyisglkfkattglfkdfidkwtyikttsygaikqlakl<br>mlnslygkfasnpdvtgkvpylkengalgfrlgeeetkdpvytpmgvfitawaryttitaaqa<br>cydriiycdtdsihltgteipdvikdivdpkklgywehestfkrakylrqktyiqdiymkevdgy<br>lvegspddytdikfsvkcagmtdkikkevtfenfkvgfsrkmkpkpvqvpggvvlvddtfti<br>kghhhhhhhhhh |
| CTerm_His10co.Phi29.-<br>D66R_Y148I_Y224K_E239G_V250I_L253A_<br>E375Y_A484E_D510K_K512Y.co<br>SEQ ID NO: 164 | mkhmprkmyscdfetttkvedcrvwaygymniedhseykignsldefmawvlkvqadl<br>yfhnlkfdgafiinwlerngfkwsadglpntyntiisrmgqwymidiclgykgkrkihtviydsl<br>kklpfpvkkiakdfkltvlkgdidihkerpvgykitpeeyayikndiqiiaealliqfkqgldrmta<br>gsdslkgfkdiitttkkfkkvfptlslgldkevrkayrggftwlndrfkgkeigegmvfdinsayp<br>aqmysrllpygepivfegkyvwdedyplhiqhircefelkegyiptiqikrsrfykgneylkss<br>ggeiadlwlsnvdlelmkehydlynveyisglkfkattglfkdfidkwtyikttsygaikqlakl<br>mlnslygkfasnpdvtgkvpylkengalgfrlgeeetkdpvytpmgvfitawaryttitaaqa<br>cydriiycdtdsihltgteipdvikdivdpkklgywehestfkrakylrqktyiqdiymkevkgy<br>lvegspddytdikfsvkcagmtdkikkevtfenfkvgfsrkmkpkpvqvpggvvlvddtfti<br>kghhhhhhhhhh |

TABLE 18-continued

Amino acid sequences of exemplary recombinant Φ29
polymerases including C-terminal exogenous features.

| | |
|---|---|
| CTerm_His10co.Phi29.-<br>N62D_Y148I_Y224K_E239G_V250I_L253A_<br>E375Y_A484E_D510K_K512Y.co<br>SEQ ID NO: 165 | mkhmprkmyscdfetttkvedcrvwaygymniedhseykignsldefmawvlkvqadl<br>yfhdlkfdgafiinwlerngfkwsadglpntyntiisrmgqwymidiclgykgkrkihtviydsl<br>kklpfpvkkiakdfkltvlkgdidihkerpvgykitpeeyayikndiqiiaealliqfkqgldrmta<br>gsdslkgfkdiittkkfkkvfptlslgldkevrkayrggftwlndrfkgkeigegmvfdinsayp<br>aqmysrllpygepivfegkyvwdedyplhiqhircefelkegyiptiqikrsrfykgneylkss<br>ggeiadlwlsnvdlelmkehydlynveyisglkfkattglfkdfidkwtyikttsygaikqlakl<br>mlnslygkfasnpdvtgkvpylkengalgfrlgeeetkdpvytpmgvfitawaryttitaaqa<br>cydriiycdtdsihltgteipdvikdivdpkklgywehestfkrakylrqktyiqdiymkevkgy<br>lvegspddytdikfsvkcagmtdkikkevtfenfkvgfsrkmkpkpvqvpggvvlvddtfti<br>kghhhhhhhhhh |
| CTerm_His10co.Phi29.-<br>K143R_Y148I_Y224K_E239G_V250I_L253A_<br>E375Y_A484E_D510K_K512Y.co<br>SEQ ID NO: 166 | mkhmprkmyscdfetttkvedcrvwaygymniedhseykignsldefmawvlkvqadl<br>yfhnlkfdgafiinwlerngfkwsadglpntyntiisrmgqwymidiclgykgkrkihtviydsl<br>kklpfpvkkiakdfkltvlrgdidihkerpvgykitpeeyayikndiqiiaealliqfkqgldrmta<br>gsdslkgfkdiittkkfkkvfptlslgldkevrkayrggftwlndrfkgkeigegmvfdinsayp<br>aqmysrllpygepivfegkyvwdedyplhiqhircefelkegyiptiqikrsrfykgneylkss<br>ggeiadlwlsnvdlelmkehydlynveyisglkfkattglfkdfidkwtyikttsygaikqlakl<br>mlnslygkfasnpdvtgkvpylkengalgfrlgeeetkdpvytpmgvfitawaryttitaaqa<br>cydriiycdtdsihltgteipdvikdivdpkklgywehestfkrakylrqktyiqdiymkevkgy<br>lvegspddytdikfsvkcagmtdkikkevtfenfkvgfsrkmkpkpvqvpggvvlvddtfti<br>kghhhhhhhhhh |
| CTerm_His10co.Phi29.-<br>D12N_Y224K_E239G_L253A_E375Y_<br>A484E_K512Y.co<br>SEQ ID NO: 167 | mkhmprkmyscnfetttkvedcrvwaygymniedhseykignsldefmawvlkvqadl<br>yfhnlkfdgafiinwlerngfkwsadglpntyntiisrmgqwymidiclgykgkrkihtviydsl<br>kklpfpvkkiakdfkltvlkgdidyhkerpvgykitpeeyayikndiqiiaealliqfkqgldrmt<br>agsdslkgfkdiittkkfkkvfptlslgldkevrkayrggftwlndrfkgkeigegmvfdinsay<br>paqmysrllpygepivfegkyvwdedyplhiqhircefelkegyiptiqikrsrfykgneylks<br>sggeiadlwlsnvdlelmkehydlynveyisglkfkattglfkdfidkwtyikttsygaikqlakl<br>mlnslygkfasnpdvtgkvpylkengalgfrlgeeetkdpvytpmgvfitawaryttitaaqa<br>cydriiycdtdsihltgteipdvikdivdpkklgywehestfkrakylrqktyiqdiymkevdgy<br>lvegspddytdikfsvkcagmtdkikkevtfenfkvgfsrkmkpkpvqvpggvvlvddtfti<br>kghhhhhhhhhh |
| CTerm_His10co.Phi29.-<br>Y148F_Y224K_E239G_V250I_L253A_E375Y_<br>A484E_D510K_K512Y.co<br>SEQ ID NO: 168 | mkhmprkmyscdfetttkvedcrvwaygymniedhseykignsldefmawvlkvqadl<br>yfhnlkfdgafiinwlerngfkwsadglpntyntiisrmgqwymidiclgykgkrkihtviydsl<br>kklpfpvkkiakdfkltvlkgdidfhkerpvgykitpeeyayikndiqiiaealliqfkqgldrmta<br>gsdslkgfkdiittkkfkkvfptlslgldkevrkayrggftwlndrfkgkeigegmvfdinsayp<br>aqmysrllpygepivfegkyvwdedyplhiqhircefelkegyiptiqikrsrfykgneylkss<br>ggeiadlwlsnvdlelmkehydlynveyisglkfkattglfkdfidkwtyikttsygaikqlakl<br>mlnslygkfasnpdvtgkvpylkengalgfrlgeeetkdpvytpmgvfitawaryttitaaqa<br>cydriiycdtdsihltgteipdvikdivdpkklgywehestfkrakylrqktyiqdiymkevkgy<br>lvegspddytdikfsvkcagmtdkikkevtfenfkvgfsrkmkpkpvqvpggvvlvddtfti<br>kghhhhhhhhhh |
| CTerm_His10co.Phi29.-<br>Y148I_Y224K_E239G_V250I_L253A_E375Y_<br>A484E_D510R_K512Y.co<br>SEQ ID NO: 169 | mkhmprkmyscdfetttkvedcrvwaygymniedhseykignsldefmawvlkvqadl<br>yfhnlkfdgafiinwlerngfkwsadglpntyntiisrmgqwymidiclgykgkrkihtviydsl<br>kklpfpvkkiakdfkltvlkgdidihkerpvgykitpeeyayikndiqiiaealliqfkqgldrmta<br>gsdslkgfkdiittkkfkkvfptlslgldkevrkayrggftwlndrfkgkeigegmvfdinsayp<br>aqmysrllpygepivfegkyvwdedyplhiqhircefelkegyiptiqikrsrfykgneylkss<br>ggeiadlwlsnvdlelmkehydlynveyisglkfkattglfkdfidkwtyikttsygaikqlakl<br>mlnslygkfasnpdvtgkvpylkengalgfrlgeeetkdpvytpmgvfitawaryttitaaqa<br>cydriiycdtdsihltgteipdvikdivdpkklgywehestfkrakylrqktyiqdiymkevrgyl<br>vegspddytdikfsvkcagmtdkikkevtfenfkvgfsrkmkpkpvqvpggvvlvddtftik<br>ghhhhhhhhhh |
| CTerm_His10co.Phi29.-<br>Y148I_Y224K_E239G_V250I_L253A_E375Y_<br>A484E_D510H_K512Y.co<br>SEQ ID NO: 170 | mkhmprkmyscdfetttkvedcrvwaygymniedhseykignsldefmawvlkvqadl<br>yfhnlkfdgafiinwlerngfkwsadglpntyntiisrmgqwymidiclgykgkrkihtviydsl<br>kklpfpvkkiakdfkltvlkgdidihkerpvgykitpeeyayikndiqiiaealliqfkqgldrmta<br>gsdslkgfkdiittkkfkkvfptlslgldkevrkayrggftwlndrfkgkeigegmvfdinsayp<br>aqmysrllpygepivfegkyvwdedyplhiqhircefelkegyiptiqikrsrfykgneylkss<br>ggeiadlwlsnvdlelmkehydlynveyisglkfkattglfkdfidkwtyikttsygaikqlakl<br>mlnslygkfasnpdvtgkvpylkengalgfrlgeeetkdpvytpmgvfitawaryttitaaqa<br>cydriiycdtdsihltgteipdvikdivdpkklgywehestfkrakylrqktyiqdiymkevhgy<br>lvegspddytdikfsvkcagmtdkikkevtfenfkvgfsrkmkpkpvqvpggvvlvddtfti<br>kghhhhhhhhhh |
| CTerm_His10co.Phi29.-<br>Y148I_Y224K_E239G_V250I_L253A_E375Y_<br>A484E_E508K_D510K_K512Y.co<br>SEQ ID NO: 171 | mkhmprkmyscdfetttkvedcrvwaygymniedhseykignsldefmawvlkvqadl<br>yfhnlkfdgafiinwlerngfkwsadglpntyntiisrmgqwymidiclgykgkrkihtviydsl<br>kklpfpvkkiakdfkltvlkgdidihkerpvgykitpeeyayikndiqiiaealliqfkqgldrmta<br>gsdslkgfkdiittkkfkkvfptlslgldkevrkayrggftwlndrfkgkeigegmvfdinsayp<br>aqmysrllpygepivfegkyvwdedyplhiqhircefelkegyiptiqikrsrfykgneylkss<br>ggeiadlwlsnvdlelmkehydlynveyisglkfkattglfkdfidkwtyikttsygaikqlakl<br>mlnslygkfasnpdvtgkvpylkengalgfrlgeeetkdpvytpmgvfitawaryttitaaqa<br>cydriiycdtdsihltgteipdvikdivdpkklgywehestfkrakylrqktyiqdiymkkvkgyl<br>vegspddytdikfsvkcagmtdkikkevtfenfkvgfsrkmkpkpvqvpggvvlvddtftik<br>ghhhhhhhhhh |

TABLE 19

Amino acid sequences of exemplary recombinant Φ29 polymerases.

| | |
|---|---|
| Phi29.L253A_E375Y_A484E_K512Y.co<br>SEQ ID NO: 172 | mkhmprkmyscdfetttkvedcrvwaygymniedhseykignsldefmawvlkvqadl<br>yfhnlkfdgafiinwlerngfkwsadglpntyntiisrmgqwymidiclgykgkrkihtviydsl<br>kklpfpvkkiakdfkltvlkgdidyhkerpvgykitpeeyayikndiqiiaeallilqfkqgldrmt<br>agsdslkgfkdiitttkkfkkvfptlslgldkevryayrggftwlndrfkekeigegmvfdvnsay<br>paqmysrllpygepivfegkyvwdedyplhiqhircefelkegyiptiqikrsrfykgneylks<br>sggeiadlwlsnvdlelmkehydlynveyisglkfkattglfkdfidkwtyiktttsygaikqlakl<br>mlnslygkfasnpdvtgkvpylkengalgfrlgeeetkdpvytpmgvfitawaryttitaaqa<br>cydriiycdtdsihltgteipdvikdivdpkklgywehestfkrakylrqktyiqdiymkevdgy<br>lvegspddytdikfsvkcagmtdkikkevtfenfkvgfsrkmkpkpvqvpggvvlvddtftik |
| Phi29.L253A_E375Y_A484E_D510K_<br>K512Y.co<br>SEQ ID NO: 173 | mkhmprkmyscdfetttkvedcrvwaygymniedhseykignsldefmawvlkvqadl<br>yfhnlkfdgafiinwlerngfkwsadglpntyntiisrmgqwymidiclgykgkrkihtviydsl<br>kklpfpvkkiakdfkltvlkgdidyhkerpvgykitpeeyayikndiqiiaeallilqfkqgldrmt<br>agsdslkgfkdiitttkkfkkvfptlslgldkevryayrggftwlndrfkekeigegmvfdvnsay<br>paqmysrllpygepivfegkyvwdedyplhiqhircefelkegyiptiqikrsrfykgneylks<br>sggeiadlwlsnvdlelmkehydlynveyisglkfkattglfkdfidkwtyiktttsygaikqlakl<br>mlnslygkfasnpdvtgkvpylkengalgfrlgeeetkdpvytpmgvfitawaryttitaaqa<br>cydriiycdtdsihltgteipdvikdivdpkklgywehestfkrakylrqktyiqdiymkevkgy<br>lvegspddytdikfsvkcagmtdkikkevtfenfkvgfsrkmkpkpvqvpggvvlvddtftik |
| Phi29.Y148I_Y224K_E239G_V250I_<br>L253A_E375Y_A484E_D510K_K512Y.co<br>SEQ ID NO: 174 | mkhmprkmyscdfetttkvedcrvwaygymniedhseykignsldefmawvlkvqadl<br>yfhnlkfdgafiinwlerngfkwsadglpntyntiisrmgqwymidiclgykgkrkihtviydsl<br>kklpfpvkkiakdfkltvlkgdidihkerpvgykitpeeyayikndiqiiaeallilqfkqgldrmta<br>gsdslkgfkdiitttkkfkkvfptlslgldkevrkayrggftwlndrfkgkeigegmvfdinsayp<br>aqmysrllpygepivfegkyvwdedyplhiqhircefelkegyiptiqikrsrfykgneylkss<br>ggeiadlwlsnvdlelmkehydlynveyisglkfkattglfkdfidkwtyiktttsygaikqlakl<br>mlnslygkfasnpdvtgkvpylkengalgfrlgeeetkdpvytpmgvfitawaryttitaaqa<br>cydriiycdtdsihltgteipdvikdivdpkklgywehestfkrakylrqktyiqdiymkevkgy<br>lvegspddytdikfsvkcagmtdkikkevtfenfkvgfsrkmkpkpvqvpggvvlvddtftik |
| Phi29.Y148I_Y224K_E239G_V250I_L253A_<br>E375Y_A484E_D510K_K512Y_E515Q.co<br>SEQ ID NO: 175 | mkhmprkmyscdfetttkvedcrvwaygymniedhseykignsldefmawvlkvqadl<br>yfhnlkfdgafiinwlerngfkwsadglpntyntiisrmgqwymidiclgykgkrkihtviydsl<br>kklpfpvkkiakdfkltvlkgdidihkerpvgykitpeeyayikndiqiiaeallilqfkqgldrmta<br>gsdslkgfkdiitttkkfkkvfptlslgldkevrkayrggftwlndrfkgkeigegmvfdinsayp<br>aqmysrllpygepivfegkyvwdedyplhiqhircefelkegyiptiqikrsrfykgneylkss<br>ggeiadlwlsnvdlelmkehydlynveyisglkfkattglfkdfidkwtyiktttsygaikqlakl<br>mlnslygkfasnpdvtgkvpylkengalgfrlgeeetkdpvytpmgvfitawaryttitaaqa<br>cydriiycdtdsihltgteipdvikdivdpkklgywehestfkrakylrqktyiqdiymkevkgy<br>lvqgspddytdikfsvkcagmtdkikkevtfenfkvgfsrkmkpkpvqvpggvvlvddtftik |
| Phi29.E239G_L253A_E375Y_A484E_D510K_<br>K512Y.co<br>SEQ ID NO: 176 | mkhmprkmyscdfetttkvedcrvwaygymniedhseykignsldefmawvlkvqadl<br>yfhnlkfdgafiinwlerngfkwsadglpntyntiisrmgqwymidiclgykgkrkihtviydsl<br>kklpfpvkkiakdfkltvlkgdidyhkerpvgykitpeeyayikndiqiiaeallilqfkqgldrmt<br>agsdslkgfkdiitttkkfkkvfptlslgldkevryayrggftwlndrfkgkeigegmvfdvnsay<br>paqmysrllpygepivfegkyvwdedyplhiqhircefelkegyiptiqikrsrfykgneylks<br>sggeiadlwlsnvdlelmkehydlynveyisglkfkattglfkdfidkwtyiktttsygaikqlakl<br>mlnslygkfasnpdvtgkvpylkengalgfrlgeeetkdpvytpmgvfitawaryttitaaqa<br>cydriiycdtdsihltgteipdvikdivdpkklgywehestfkrakylrqktyiqdiymkevkgy<br>lvegspddytdikfsvkcagmtdkikkevtfenfkvgfsrkmkpkpvqvpggvvlvddtftik |
| Phi29.-<br>Y224K_E239G_L253A_E375Y_A484E_D510K_<br>K512Y.co<br>SEQ ID NO: 177 | mkhmprkmyscdfetttkvedcrvwaygymniedhseykignsldefmawvlkvqadl<br>yfhnlkfdgafiinwlerngfkwsadglpntyntiisrmgqwymidiclgykgkrkihtviydsl<br>kklpfpvkkiakdfkltvlkgdidyhkerpvgykitpeeyayikndiqiiaeallilqfkqgldrmt<br>agsdslkgfkdiitttkkfkkvfptlslgldkevrkayrggftwlndrfkgkeigegmvfdvnsay<br>paqmysrllpygepivfegkyvwdedyplhiqhircefelkegyiptiqikrsrfykgneylks<br>sggeiadlwlsnvdlelmkehydlynveyisglkfkattglfkdfidkwtyiktttsygaikqlakl<br>mlnslygkfasnpdvtgkvpylkengalgfrlgeeetkdpvytpmgvfitawaryttitaaqa<br>cydriiycdtdsihltgteipdvikdivdpkklgywehestfkrakylrqktyiqdiymkevkgy<br>lvegspddytdikfsvkcagmtdkikkevtfenfkvgfsrkmkpkpvqvpggvvlvddtftik |
| Phi29.Y148I_Y224K_E239G_L253C_E375Y_<br>A484E_D510K_K512Y.co<br>SEQ ID NO: 178 | mkhmprkmyscdfetttkvedcrvwaygymniedhseykignsldefmawvlkvqadl<br>yfhnlkfdgafiinwlerngfkwsadglpntyntiisrmgqwymidiclgykgkrkihtviydsl<br>kklpfpvkkiakdfkltvlkgdidihkerpvgykitpeeyayikndiqiiaeallilqfkqgldrmta<br>gsdslkgfkdiitttkkfkkvfptlslgldkevrkayrggftwlndrfkgkeigegmvfdvnscyp<br>aqmysrllpygepivfegkyvwdedyplhiqhircefelkegyiptiqikrsrfykgneylkss<br>ggeiadlwlsnvdlelmkehydlynveyisglkfkattglfkdfidkwtyiktttsygaikqlakl<br>mlnslygkfasnpdvtgkvpylkengalgfrlgeeetkdpvytpmgvfitawaryttitaaqa<br>cydriiycdtdsihltgteipdvikdivdpkklgywehestfkrakylrqktyiqdiymkevkgy<br>lvegspddytdikfsvkcagmtdkikkevtfenfkvgfsrkmkpkpvqvpggvvlvddtftik |

TABLE 19-continued

Amino acid sequences of exemplary recombinant Φ29 polymerases.

N62D_V250I_L253A_E375Y_A484E_K512Y.co
SEQ ID NO: 179 mkhmprkmyscdfetttkvedcrvwaygymniedhseykignsldefmawvlkvqadl
yfhdlkfdgafiinwlerngfkwsadglpntyntiisrmgqwymidiclgykgkrkihtviydsl
kklpfpvkkiakdfkltvlkgdidyhkerpvgykitpeeyayikndiqiiaeallifqkqgldrmt
agsdslkgfkdiittkkfkkvfptlslgldkevryayrggftwlndrfkekeigegmvfdinsay
paqmysrllpygepivfegkyvwdedyplhiqhircefelkegyiptiqikrsrfykgneylks
sggeiadlwlsnvdlelmkehydlynveyisglkfkattglfkdfidkwtyiktttsygaikqlakl
mlnslygkfasnpdvtgkvpylkengalgfrlgeeetkdpvytpmgvfitawaryttitaaqa
cydriiycdtdsihltgteipdvikdivdpkklgywehestfkrakylrqktyiqdiymkevdgy
lvegspddytdikfsvkcagmtdkikkevtfenfkvgfsrkmkpkpvqvpggvvlvddtftik Phi29.Y224K_E239G_L253A_E375Y_A484E_K512Y_F526L.co
SEQ ID NO: 180 mkhmprkmyscdfetttkvedcrvwaygymniedhseykignsldefmawvlkvqadl
yfhnlkfdgafiinwlerngfkwsadglpntyntiisrmgqwymidiclgykgkrkihtviydsl
kklpfpvkkiakdfkltvlkgdidyhkerpvgykitpeeyayikndiqiiaeallifqkqgldrmt
agsdslkgfkdiittkkfkkvfptlslgldkevryayrggftwlndrfkekeigegmvfdvnsay
paqmysrllpygepivfegkyvwdedyplhiqhircefelkegyiptiqikrsrfykgneylks
sggeiadlwlsnvdlelmkehydlynveyisglkfkattglfkdfidkwtyiktttsygaikqlakl
mlnslygkfasnpdvtgkvpylkengalgfrlgeeetkdpvytpmgvfitawaryttitaaqa
cydriiycdtdsihltgteipdvikdivdpkklgywehestfkrakylrqktyiqdiymkevdgy
lvegspddytdiklsvkcagmtdkikkevtfenfkvgfsrkmkpkpvqvpggvvlvddtftik Phi29.L253A_E375Y_A484E_K512Y_E515K.co
SEQ ID NO: 181 mkhmprkmyscdfetttkvedcrvwaygymniedhseykignsldefmawvlkvqadl
yfhnlkfdgafiinwlerngfkwsadglpntyntiisrmgqwymidiclgykgkrkihtviydsl
kklpfpvkkiakdfkltvlkgdidyhkerpvgykitpeeyayikndiqiiaeallifqkqgldrmt
agsdslkgfkdiittkkfkkvfptlslgldkevryayrggftwlndrfkekeigegmvfdvnsay
paqmysrllpygepivfegkyvwdedyplhiqhircefelkegyiptiqikrsrfykgneylks
sggeiadlwlsnvdlelmkehydlynveyisglkfkattglfkdfidkwtyiktttsygaikqlakl
mlnslygkfasnpdvtgkvpylkengalgfrlgeeetkdpvytpmgvfitawaryttitaaqa
cydriiycdtdsihltgteipdvikdivdpkklgywehestfkrakylrqktyiqdiymkevdgy
lvkgspddytdikfsvkcagmtdkikkevtfenfkvgfsrkmkpkpvqvpggvvlvddtftik Phi29.E239G_L253A_E375Y_A484E_E508R_K512Y.co
SEQ ID NO: 182 mkhmprkmyscdfetttkvedcrvwaygymniedhseykignsldefmawvlkvqadlyfhn
lkfdgafiinwlerngfkwsadglpntyntiisrmgqwymidiclgykgkrkihtviydslkklp
fpvkkiakdfkltvlkgdidyhkerpvgykitpeeyayikndiqiiaeallifqkqgldrmtags
dslkgfkdiittkkfkkvfptlslgldkevryayrggftwlndrfkgkeigegmvfdvnsaypaq
mysrllpygepivfegkyvwdedyplhiqhircefelkegyiptiqikrsrfykgneylkssgg
eiadlwlsnvdlelmkehydlynveyisglkfkattglfkdfidkwtyiktttsygaikqlaklmln
slygkfasnpdvtgkvpylkengalgfrlgeeetkdpvytpmgvfitawaryttitaaqacyd
riiycdtdsihltgteipdvikdivdpkklgywehestfkrakylrqktyiqdiymkrvdgylveg
spddytdikfsvkcagmtdkikkevtfenfkvgfsrkmkpkpvqvpggvvlvddtftik Phi29.Y148I_L253A_E375Y_A484E_K512Y.co
SEQ ID NO: 183 mkhmprkmyscdfetttkvedcrvwaygymniedhseykignsldefmawvlkvqadl
yfhnlkfdgafiinwlerngfkwsadglpntyntiisrmgqwymidiclgykgkrkihtviydsl
kklpfpvkkiakdfkltvlkgdididhkerpvgykitpeeyayikndiqiiaeallifqkqgldrmta
gsdslkgfkdiittkkfkkvfptlslgldkevryayrggftwlndrfkekeigegmvfdvnsayp
aqmysrllpygepivfegkyvwdedyplhiqhircefelkegyiptiqikrsrfykgneylkss
ggeiadlwlsnvdlelmkehydlynveyisglkfkattglfkdfidkwtyiktttsygaikqlakl
mlnslygkfasnpdvtgkvpylkengalgfrlgeeetkdpvytpmgvfitawaryttitaaqa
cydriiycdtdsihltgteipdvikdivdpkklgywehestfkrakylrqktyiqdiymkevdgy
lvegspddytdikfsvkcagmtdkikkevtfenfkvgfsrkmkpkpvqvpggvvlvddtftik Phi29.D66R_Y148I_Y224K_E239G_V250I_L253A_E375Y_A484E_D510K_K512Y.co
SEQ ID NO: 184 mkhmprkmyscdfetttkvedcrvwaygymniedhseykignsldefmawvlkvqadl
yfhnlkfrgafiinwlerngfkwsadglpntyntiisrmgqwymidiclgykgkrkihtviydsl
kklpfpvkkiakdfkltvlkgdididhkerpvgykitpeeyayikndiqiiaeallifqkqgldrmta
gsdslkgfkdiittkkfkkvfptlslgldkevrkayrggftwlndrfkgkeigegmvfdinsayp
aqmysrllpygepivfegkyvwdedyplhiqhircefelkegyiptiqikrsrfykgneylkss
ggeiadlwlsnvdlelmkehydlynveyisglkfkattglfkdfidkwtyiktttsygaikqlakl
mlnslygkfasnpdvtgkvpylkengalgfrlgeeetkdpvytpmgvfitawaryttitaaqa
cydriiycdtdsihltgteipdvikdivdpkklgywehestfkrakylrqktyiqdiymkevkgy
lvegspddytdikfsvkcagmtdkikkevtfenfkvgfsrkmkpkpvqvpggvvlvddtftik Phi29.N62D_Y148I_Y224K_E239G_V250I_L253A_E375Y_A484E_D510K_K512Y.co
SEQ ID NO: 185 mkhmprkmyscdfetttkvedcrvwaygymniedhseykignsldefmawvlkvqadl
yfhdlkfdgafiinwlerngfkwsadglpntyntiisrmgqwymidiclgykgkrkihtviydsl
kklpfpvkkiakdfkltvlkgdididhkerpvgykitpeeyayikndiqiiaeallifqkqgldrmta
gsdslkgfkdiittkkfkkvfptlslgldkevrkavrggftwlndrfkgkeigegmvfdinsayp
aqmysrllpygepivfegkyvwdedyplhiqhircefelkegyiptiqikrsrfykgneylkss
ggeiadlwlsnvdlelmkehydlynveyisglkfkattglfkdfidkwtyiktttsygaikqlakl
mlnslygkfasnpdvtgkvpylkengalgfrlgeeetkdpvytpmgvfitawaryttitaaqa
cydriiycdtdsihltgteipdvikdivdpkklgywehestfkrakylrqktyiqdiymkevkgy
lvegspddytdikfsvkcagmtdkikkevtfenfkvgfsrkmkpkpvqvpggvvlvddtftik TABLE 19-continued Amino acid sequences of exemplary recombinant Φ29 polymerases.

| Name | Sequence |
|---|---|
| Phi29.K143R_Y148I_Y224K_E239G_V250I_L253A_E375Y_A484E_D510K_K512Y.co<br>SEQ ID NO: 186 | mkhmprkmyscdfetttkvedcrvwaygymniedhseykignsldefmawvlkvqadl<br>yfhnlkfdgafiinwlerngfkwsadglpntyntiisrmgqwymidiclgykgkrkihtviydsl<br>kklpfpvkkiakdfkltvlrgdidihkerpvgykitpeeyayikndiqiiaealliqfkqgldrmta<br>gsdslkgfkdiittkkfkkvfptlslgldkevrkayrggftwlndrfkgkeigegmvfdinsayp<br>aqmysrllpygepivfegkyvwdedyplhiqhircefelkegyiptiqikrsrfykgneylkss<br>ggeiadlwlsnvdlelmkehydlynveyisglkfkattglfkdfidkwtyikttsygaikqlakl<br>mlnslygkfasnpdvtgkvpylkengalgfrlgeeetkdpvytpmgvfitawaryttitaaqa<br>cydriiycdtdsihltgteipdvikdivdpkklgywehestfkrakylrqktyiqdiymkevkgy<br>lvegspddytdikfsvkcagmtdkikkevtfenfkvgfsrkmkpkpvqvpggvvlvddtftik |
| Phi29.D12N_Y224K_E239G_L253A_E375Y_A484E_K512Y.co<br>SEQ ID NO: 187 | mkhmprkmyscnfetttkvedcrvwaygymniedhseykignsldefmawvlkvqadl<br>yfhnlkfdgafiinwlerngfkwsadglpntyntiisrmgqwymidiclgykgkrkihtviydsl<br>kklpfpvkkiakdfkltvlkgdidyhkerpvgykitpeeyayikndiqiiaealliqfkqgldrmt<br>agsdslkgfkdiittkkfkkvfptlslgldkevrkayrggftwlndrfkgkeigegmvfdvnsay<br>paqmysrllpygepivfegkyvwdedyplhiqhircefelkegyiptiqikrsrfykgneylks<br>sggeiadlwlsnvdlelmkehydlynveyisglkfkattglfkdfidkwtyikttsygaikqlakl<br>mlnslygkfasnpdvtgkvpylkengalgfrlgeeetkdpvytpmgvfitawaryttitaaqa<br>cydriiycdtdsihltgteipdvikdivdpkklgywehestfkrakylrqktyiqdiymkevdgy<br>lvegspddytdikfsvkcagmtdkikkevtfenfkvgfsrkmkpkpvqvpggvvlvddtftik |
| Phi29.Y148F_Y224K_E239G_V250I_L253A_E375Y_A484E_D510K_K512Y.co<br>SEQ ID NO: 188 | mkhmprkmyscdfetttkvedcrvwaygymniedhseykignsldefmawvlkvqadl<br>yfhnlkfdgafiinwlerngfkwsadglpntyntiisrmgqwymidiclgykgkrkihtviydsl<br>kklpfpvkkiakdfkltvlkgdidfhkerpvgykitpeeyayikndiqiiaealliqfkqgldrmta<br>gsdslkgfkdiittkkfkkvfptlslgldkevrkayrggftwlndrfkgkeigegmvfdinsayp<br>aqmysrllpygepivfegkyvwdedyplhiqhircefelkegyiptiqikrsrfykgneylkss<br>ggeiadlwlsnvdlelmkehydlynveyisglkfkattglfkdfidkwtyikttsygaikqlakl<br>mlnslygkfasnpdvtgkvpylkengalgfrlgeeetkdpvytpmgvfitawaryttitaaqa<br>cydriiycdtdsihltgteipdvikdivdpkklgywehestfkrakylrqktyiqdiymkevkgy<br>lvegspddytdikfsvkcagmtdkikkevtfenfkvgfsrkmkpkpvqvpggvvlvddtftik |
| Phi29.Y148I_Y224K_E239G_V250I_L253A_E375Y_A484E_D510R_K512Y.co<br>SEQ ID NO: 189 | mkhmprkmyscdfetttkvedcrvwaygymniedhseykignsldefmawvlkvqadl<br>yfhnlkfdgafiinwlerngfkwsadglpntyntiisrmgqwymidiclgykgkrkihtviydsl<br>kklpfpvkkiakdfkltvlkgdidihkerpvgykitpeeyayikndiqiiaealliqfkqgldrmta<br>gsdslkgfkdiittkkfkkvfptlslgldkevrkayrggftwlndrfkgkeigegmvfdinsayp<br>aqmysrllpygepivfegkyvwdedyplhiqhircefelkegyiptiqikrsrfykgneylkss<br>ggeiadlwlsnvdlelmkehydlynveyisglkfkattglfkdfidkwtyikttsygaikqlakl<br>mlnslygkfasnpdvtgkvpylkengalgfrlgeeetkdpvytpmgvfitawaryttitaaqa<br>cydriiycdtdsihltgteipdvikdivdpkklgywehestfkrakylrqktyiqdiymkevrgyl<br>vegspddytdikfsvkcagmtdkikkevtfenfkvgfsrkmkpkpvqvpggvvlvddtftik |
| Phi29.Y148I_Y224K_E239G_V250I_L253A_E375Y_A484E_D510H_K512Y.co<br>SEQ ID NO: 190 | mkhmprkmyscdfetttkvedcrvwaygymniedhseykignsldefmawvlkvqadl<br>yfhnlkfdgafiinwlerngfkwsadglpntyntiisrmgqwymidiclgykgkrkihtviydsl<br>kklpfpvkkiakdfkltvlkgdidihkerpvgykitpeeyayikndiqiiaealliqfkqgldrmta<br>gsdslkgfkdiittkkfkkvfptlslgldkevrkayrggftwlndrfkgkeigegmvfdinsayp<br>aqmysrllpygepivfegkyvwdedyplhiqhircefelkegyiptiqikrsrfykgneylkss<br>ggeiadlwlsnvdlelmkehydlynveyisglkfkattglfkdfidkwtyikttsygaikqlakl<br>mlnslygkfasnpdvtgkvpylkengalgfrlgeeetkdpvytpmgvfitawaryttitaaqa<br>cydriiycdtdsihltgteipdvikdivdpkklgywehestfkrakylrqktyiqdiymkevhgy<br>lvegspddytdikfsvkcagmtdkikkevtfenfkvgfsrkmkpkpvqvpggvvlvddtftik |
| Phi29.Y148I_Y224K_E239G_V250I_L253A_E375Y_A484E_E508K_D510K_K512Y.co<br>SEQ ID NO: 191 | mkhmprkmyscdfetttkvedcrvwaygymniedhseykignsldefmawvlkvqadl<br>yfhnlkfdgafiinwlerngfkwsadglpntyntiisrmgqwymidiclgykgkrkihtviydsl<br>kklpfpvkkiakdfkltvlkgdidihkerpvgykitpeeyayikndiqiiaealliqfkqgldrmta<br>gsdslkgfkdiittkkfkkvfptlslgldkevrkayrggftwlndrfkgkeigegmvfdinsayp<br>aqmysrllpygepivfegkyvwdedyplhiqhircefelkegyiptiqikrsrfykgneylkss<br>ggeiadlwlsnvdlelmkehydlynveyisglkfkattglfkdfidkwtyikttsygaikqlakl<br>mlnslygkfasnpdvtgkvpylkengalgfrlgeeetkdpvytpmgvfitawaryttitaaqa<br>cydriiycdtdsihltgteipdvikdivdpkklgywehestfkrakylrqktyiqdiymkkvkgyl<br>vegspddytdikfsvkcagmtdkikkevtfenfkvgfsrkmkpkpvqvpggvvlvddtftik |

Additional exemplary polymerase mutations and/or combinations thereof are provided in FIG. 35; positions of the mutations are identified relative to a wild-type Φ29 DNA polymerase (SEQ ID NO:1). Where the feature "topo V fusion" is listed, it indicates that the polymerase includes a fusion as described in de Vega et al. (2010) "Improvement of φ29 DNA polymerase amplification performance by fusion of DNA binding motifs" Proc Natl Acad Sci USA 107:16506-16511. "pET16" refers to a vector used to produce a recombinant Φ29 polymerase comprising the indicated mutations, and "co" indicates that the polynucleotide sequence encoding certain features has been codon optimized; neither notation is relevant to the structure of the polymerase, nor are the mutations or combinations of mutations shown in FIG. 35 limited to use in a Φ29 polymerase. Essentially any of these mutations, any combination of these mutations, and/or any combination of these mutations with the other mutations disclosed herein can be introduced into a polymerase (e.g., Φ29-type polymerase) to produce a modified recombinant polymerase in accordance with the invention.

EXAMPLES

It is understood that the examples and embodiments described herein are for illustrative purposes only and that various modifications or changes in light thereof will be suggested to persons skilled in the art and are to be included within the spirit and purview of this application and scope of the appended claims. Accordingly, the following examples are offered to illustrate, but not to limit, the claimed invention.

Example 1

Determination of Branching Fractions for Modified Recombinant Polymerases

An active polymerase:template:analog ternary complex can be created in a 'static' non-extending (a.k.a 'sampling') configuration by including in the reaction a divalent cation that supports access of analog bases into the binding pocket but does not have sufficient coordination capability to allow the active configuration of the analog be assumed. The divalent cation that most efficiently fulfills this function for a polymerase extension reaction is calcium.

Figure 11A:
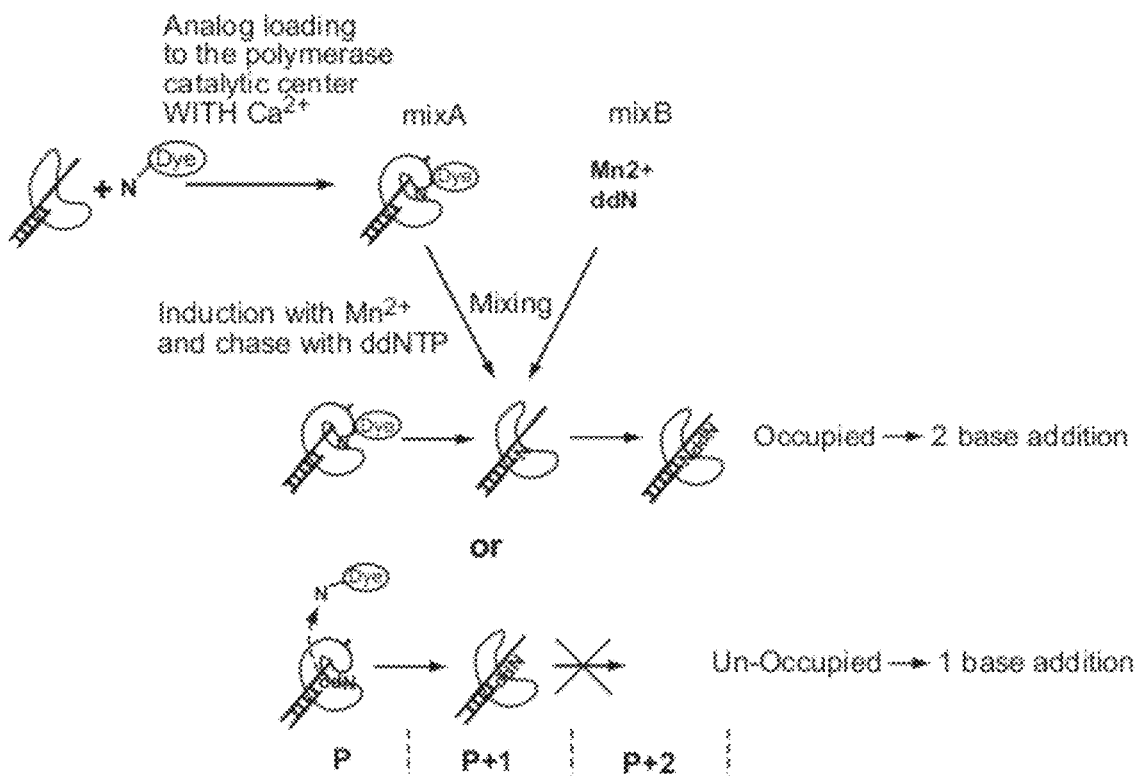
FIG. 11 Panel A schematically illustrates an assay for determination of branching fraction. Panel B illustrates detection of primer (P) and +1 and +2 products by gel electrophoresis.
Figure 11B:
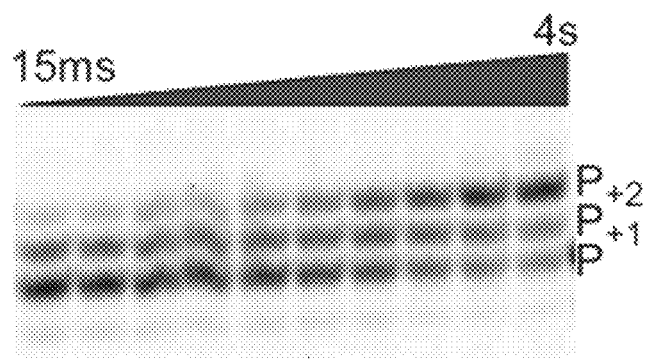

To perform a branching fraction assay, this static structure is leveraged by (for any variant being tested) initiating such a reaction that precludes extension, then (at a fixed time point) 'chasing' this state with saturating amounts of a dideoxynucleotide (or other non-hydrolyzable analog), extendable base analogs, and a divalent cation that supports product extension. The simultaneous addition of these three components results in sites that are unoccupied at the time of the 'chase' being terminated by the rapid, high-affinity binding of the non-hydrolyzable analog. This results in generation of a product that is only a single base longer then the original primer. Sites that are 'occupied' (i.e. contain the cognate, but unpaired, analog base) will (as a result of the 'chase' reaction) proceed with extension (the resident analog base completes chemistry with the free 3' OH group of the primer) and thereby generates a product that can be detected as a two (or more)-base addition(s). The ratio of the amount of these two products is used to estimate the proportion of unoccupied and occupied sites at an equilibrium state and therefore is proportional to the rate of branching. The assay is schematically illustrated in FIG. 11 Panel A.

Materials and Methods

In general, branching fraction can be determined as follows. Combine polymerase sample with 1 mM calcium chloride, the analog for testing, and an appropriate template:primer where the bases at position +1 and +2 are complementary to the test analog. Incubate at optimum polymerase reaction temperature for 5 minutes. Add to this reaction an equal volume of the same formulation containing 20-fold level of manganese over the calcium chloride concentration and 0.5 mM of a non-hydrolyzable nucleotide (of the same base as the analog being tested). Incubate at same temperature for 30 seconds. Terminate the reaction either by adding EDTA to a final concentration of 100 mM or by adding a denaturing reagent such as formamide. Analyze samples to determine the amounts of the +1 and +2 products—this can be done by acrylamide gel electrophoresis (FIG. 11 Panel B) or capillary electrophoresis. The branching fraction is calculated as the proportion of the amount of the +1 product to the total amount of products formed (+1++2), i.e., branching fraction=$P_{+1}/(P_{+1}+P_{+2})$.

Branching fraction data presented for the Φ29 polymerase mutants in Table 5 was determined accordingly, under the following conditions. The analog, template, and primer employed were analog A555-dT6P, template 5'-ACGACGT-TGACAATAATACAAGTCCGATACAT-GATAATTACCGATAAGTTCGTC GAGAGCACATTAG-GCTGGCTG G-3' (SEQ ID NO:194), and primer 5' 6-FAM/CCAGCCAGCCTAATGTGCTCTCGACGAACTTATCG-GTAATTATCATGTATC GGA C-3' (SEQ ID NO:195).

Combine 130 nM Polymerase with 40 nM annealed Template:Primer in a solution containing 1 mM $CaCl_2$, 5 uM Analog, 0.095% Triton X-100, 75 mM Potassium Acetate, 5 mM DTT in 50 mM ACES pH 7.25 at a volume of 20 uL. Incubate at room temperature for 5 minutes. In a separate tube, combine 20 mM $MnCl_2$ with 0.5 mM 3'-amino-2' ddTTP in 50 mm ACES pH 7.25. At the completion of the 5 minute incubation step, transfer 20 uL of the second mix to the first. Incubate for 30 seconds at room temperature. Add EDTA to 5 mM to quench the reaction. Analyze samples by separating fragments by capillary electrophoresis and calculating integrated peak areas of the products.

Example 2

Polymerase Systems Having Two Kinetically Observable Steps—Stopped Flow Measurements This experiment describes the observation of a polymerase system having two kinetically observable steps (two slow steps) where the two kinetically observable steps occur while the nucleotide is associated with the enzyme (after nucleotide binding and through product release). In the experiment described here, the two kinetically observable steps would correspond to steps occurring in the bright state of a single-molecule sequencing system using nucleotides having dyes attached to the terminal phosphate of the nucleotides.

The oligonucleotides that constitute the template/primer complex were purchased from Integrated DNA Technologies (Coralville, Iowa). The position iAmMC6T has an Int amino modified C6 dT substituted for dT at this position. The "template" oligonucleotide was labeled at position "iAmMC6T" with alexa fluor 488 fluorescent dye. Sequence of oligonucleotides used for the assays were

```
                                    (SEQ ID NO: 196)
5'-GGT GAT GTA GAT AGG TGG TAG GTG GTG
TCA    GAT C (SEQ ID NO: 197)
3'-CCA CTA CAT CTA TCC ACC ATC CAC CAC
AG/iAmMC6T/CTA GGC ATA ATA ACA GTT GCA GCA.
```

This stopped-flow assay relies on the quenching, for example by fluorescent resonance energy transfer (FRET) of the fluorescence of the Alexa fluor 488 attached to the template by a dye labeled nucleotide. A nucleotide having an Alexa fluor 555 as a terminal phosphate label is used in the polymerase reaction, which will quench the fluorescence of the Alexa fluor 488 dye attached to the template only when the nucleotide is associated with (bound to) the polymerase enzyme.

For this assay a SF-2004 stopped-flow instrument (Kintek Corp, Austin, Tex.) is used to monitor the fluorescence at 535 nm (using a band pass filter), to measure Alexa fluor 488 emission. The enzyme, DNA, buffer, potassium acetate, and dithiothreitol (DTT) are mixed in one sample and allowed to equilibrate. Alexa-555-dC6P (a terminally labeled hexaphosphate nucleotide substrate), buffer, potassium acetate, DTT, $MnCl_2$, and $CaCl_2$ are mixed in a second sample. The stopped-flow instrument rapidly mixes these samples and reads the fluorescent signal at 535 nm as a function of time.

The drop in the fluorescent signal, measured at 535 nM, is attributed to binding of the Alexa-555-dC6P nucleotide to the enzyme-DNA complex. Because quenching only occurs when the two dyes are in close proximity, a significant drop in the fluorescence of alexa fluor 488 due to the presence of alexa fluor 555 in solution would not be expected to occur. Alexa-555-dC6P bound in the active site of the enzyme, however, will cause a drop in the fluorescence of alexa fluor 488 labeled oligonucleotide. The rate of drop of the measured fluorescence signal is a function of the rate of binding of the nucleotide to the active site of the enzyme.

Once bound, the nucleotide analog can undergo nucleotidyl transfer catalyzed by the polymerase enzyme, extending the oligonucleotide. Subsequent to extension of the oligonucleotide, the product, the alexa fluor 555-pentaphosphate is released from the enzyme. Once released from the enzyme DNA complex, the alexa fluor 555-pentaphosphate no longer quenches the alexa fluor 488 attached to the template in the enzyme-DNA complex, and the measured fluorescence signal increases at a rate that is a function of the release of product.

The binding of the nucleotide to the enzyme-DNA complex is often observed to occur as a single exponential decrease in the fluorescence signal, indicating a process with a single kinetically observable step. Where the steps of the polymerase reaction from after binding through release of the pentaphosphate-dye molecule are governed by a single rate limiting step a single exponential increase in the fluorescent signal is expected. Thus, in the scenario where nucleotide binding and the subsequent steps through product release are each governed by single rate limiting steps, a fluorescent signal that is adequately described by a sum of two exponentials is observed.

FIG. 15 shows the data from a polymerase reaction system in which the decrease in the fluorescent signal fits to a single exponential having an observed rate constant of 156±3 $s^{-1}$, and the increase in signal fits to a single exponential having an observed rate constant of 8.5±0.1$s^{-1}$. FIG. 15 includes both the experimental data and the curve fits for single exponential decay and rise in fluorescence. The polymerase reaction shown in FIG. 15 involved a modified phi29 DNA polymerase having the mutations N62D/T368F/E375Y/K512Y and modified for streptavidin binding (polymerase R) in 50 mM ACES buffer at a pH of 7.1. The assay was performed with the following components and amounts: 0.125 µM polymerase R enzyme, 0.025 µM DNA, 50 mM ACES, pH 7.1, 0.7 mM $MnCl_2$, 75 mM potassium acetate, 5 mM dithiothreitol, 3 µM alexa 555-dC6P. The observed fluorescent signal was fit to a sum of two exponentials, where the rate of the drop is 156±3 $s^{-1}$, and the rate of the increase in signal is 8.5±0.1$s^{-1}$.

Figure 16:
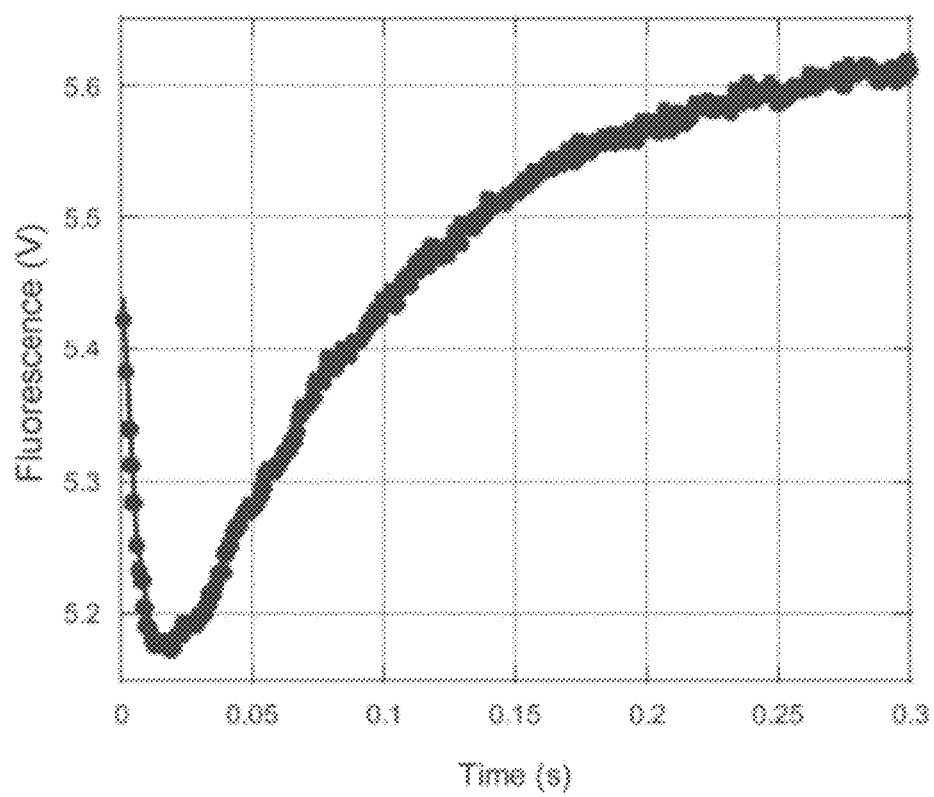
FIG. 16 shows the results of a stopped-flow experiment for a polymerase reaction system in which the decrease in the fluorescent signal fits to a single exponential and the increase in signal is best described by two exponentials.

FIG. 16 shows the data for a polymerase reaction system which exhibits two kinetically observable steps for the steps after nucleotide binding through product release. The polymerase reaction used the enzyme polymerase R in 50 mM Tris buffer, at pH 7.1, with 0.25 mM $CaCl_2$. The assay used 0.125 µM polymerase R enzyme, 0.025 µM DNA, 50 mM Tris, pH 7.1, 0.7 mM $MnCl_2$, 0.25 mM $CaCl_2$, 75 mM potassium acetate, 5 mM dithiothreitol, 3 µM alexa 555-dC6P. A good fit to the data could not be obtained with two exponentials. However, a good quality fit was obtained using the sum of three exponentials. The drop in fluorescence occurs with a single exponential having an observed rate constant of 172±12 $s^{-1}$. The increase in fluorescence is best described as the sum of two exponentials, where the faster of the two steps occurs with an observed rate constant of 60±10 $s^{-1}$, and the slower of the two steps occurs with an observed rate constant of 12.0±0.1$s^{-1}$. The behavior of this system is best described by two kinetically observable steps during the part of the polymerase reaction in which the nucleotide is associated with the enzyme. Each of the steps is partially rate limiting. The observed fluorescent signal is fit to a sum of three exponentials, where the observed rate constant for the drop in fluorescence is 172±12 $s^{-1}$, and the increase in fluorescence exhibits two kinetically observable rate constants, one at 60±10 $s^{-1}$ and the other at 12.0±0.1$s^{-1}$.

Figure 17:
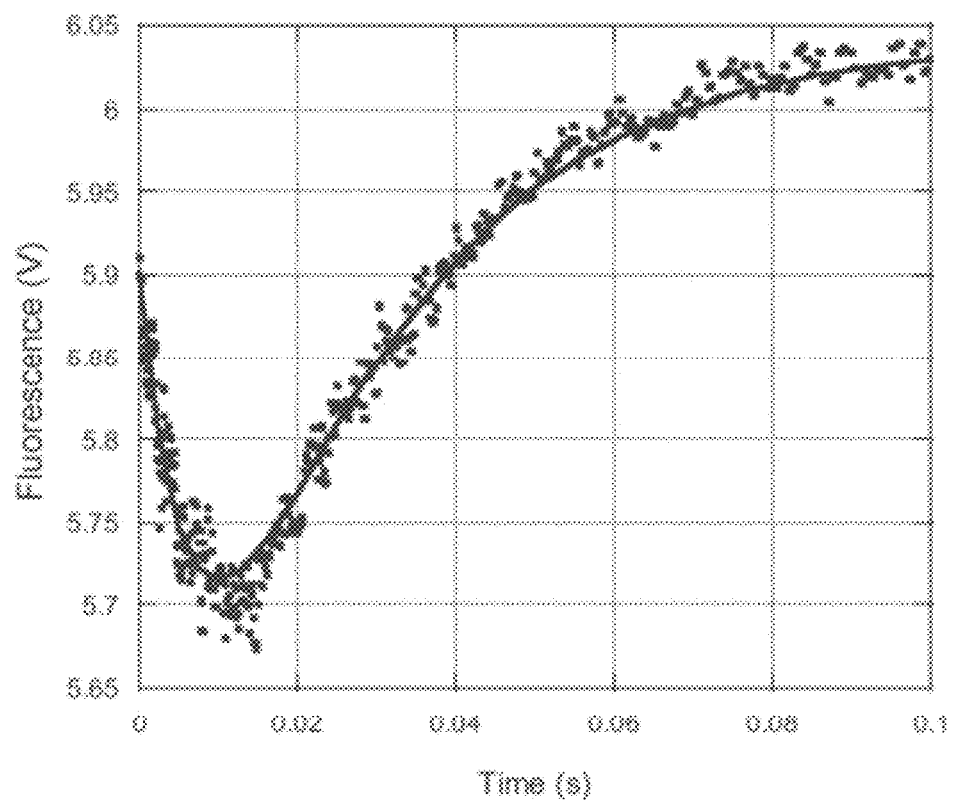
FIG. 17 shows the results of a stopped-flow experiment for a polymerase reaction system in which the decrease in the fluorescent signal fits to a single exponential and the increase in signal fits to a single exponential.

FIG. 17 shows stopped-flow experimental data for a polymerase having a drop in fluorescence and a rise in fluorescence which each can be fit to a single exponential. FIG. 17 shows the incorporation of Alexa 555-dC6P by a phi29 DNA polymerase enzyme having the mutations N62D/T368F/E375Y/A484E/K512Y and modified for streptavidin binding (polymerase T) in 50 mM Tris buffer, pH 7.1. The assay used 0.125 µM polymerase T enzyme, 0.025 µM DNA, 50 mM Tris, pH 7.1, 0.7 mM $MnCl_2$, 75 mM potassium acetate, 5 mM dithiothreitol, 3 µM alexa 555-dC6P. The observed fluorescent signal is fit to a sum of two exponentials, where the rate of the drop has an observed rate constant of 118±4 s−1, and the increase in the signal rate limiting step occurs with an observed rate constant of 46±1s−1.

Figure 18A:
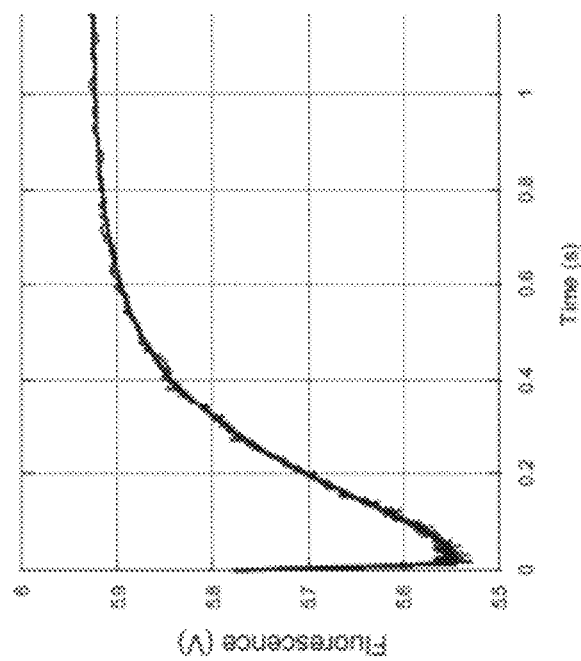
FIG. 18 Panels A and B show the results of a stopped-flow experiment for a polymerase reaction system in which the decrease in the fluorescent signal fits to a single exponential and the increase in signal is best described by to two exponentials (Panel B), and is poorly fit by a single exponential (Panel A).
Figure 18B:
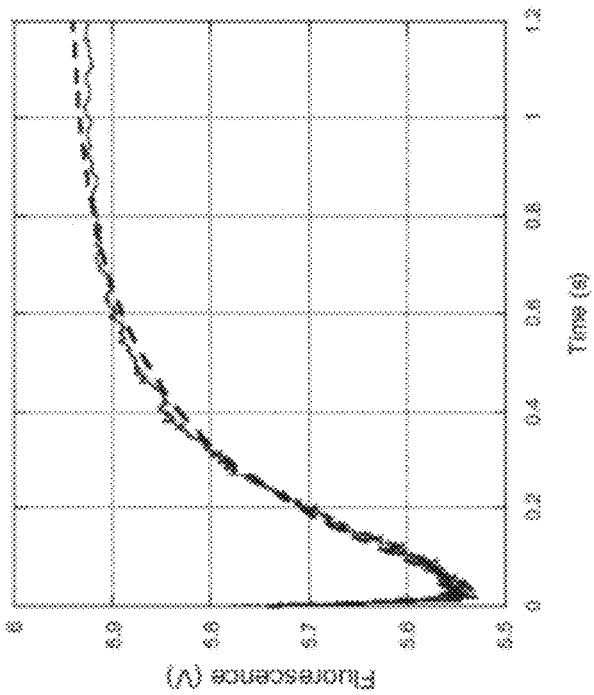

FIG. 18 illustrates how changing the polymerase reaction conditions can produce a polymerase reaction system which exhibits two kinetically observable rate limiting steps for the steps after nucleotide binding through product release. In this case, without limitation to any particular mechanism, it is believed that specific enzyme mutations in the polymerase T enzyme, coupled with the presence of Ca++ under the conditions of the polymerase reaction described, has changed the kinetic performance of the system to obtain a system in which there are two kinetically observable rate constants between nucleotide binding through product release with almost equal rate constants. FIG. 18 shows stopped-flow data for the incorporation of Alexa 555-dC6P by polymerase enzyme polymerase T in 50 mM Tris buffer, pH 7.1, with 1.25 mM $CaCl_2$. The assay used 0.125 µM polymerase T enzyme, 0.025 µM DNA, 50 mM Tris, pH 7.1, 0.7 mM $MnCl_2$, 1.25 mM $CaCl_2$, 75 mM potassium acetate, 5 mM dithiothreitol, 3 µM alexa 555-dC6P. FIG. 18 Panel A shows an attempt to fit the data with two exponentials, one for the decay, and the other for the rise in fluorescence. It can be seen from FIG. 18 Panel A that the data is not well described in this manner. FIG. 18 Panel B shows the observed fluorescent signal fit to a sum of three exponentials where the rate constant for the drop in fluorescence is 157±5 $s^{-1}$, and the increase in the signal exhibits two kinetically observable steps, where one step exhibits an observed rate constant of 9±2 $s^{-1}$ and the other step exhibits a rate constant of 7±1$s^{-1}$. The conditions that resulted in the two kinetically observable steps of FIG. 18 Panel B are the same as those for the experiment shown in FIG. 17, except for the presence of $CaCl_2$ at a concentration of 1.25 mM in this experiment.

A similar stopped-flow experiment was performed with a modified Φ29 DNA polymerase having the mutations N62D/T368F/E375Y/K512Y/N387L in Tris buffer at a pH of 7.1 with 0.5 mM $MnCl_2$ and no added $CaCl_2$. Data was fit with three exponentials, revealing a ratio between the two slow rates of about 0.5.

Example 3

Stopped Flow Experiment to Observe Two Kinetically Observable Steps for the Steps after Product Release Through Nucleotide Binding The presence of two kinetically observable steps after product release through nucleic acid binding can be observed by measuring the difference in the kinetics of single incorporation and multiple incorporations. First, a transient incorporation nucleotide incorporation assay (rapid chemical quench flow or stopped-flow fluorescence) is performed in order to determine the apparent rate constant for binding of a first nucleotide. Next, the experiment is run such that two nucleotides are incorporated. By comparing the kinetic parameters for the incorporation of two nucleotides as compared to those for incorporating one nucleotide, it can be determined whether there is an intervening step, such as translocation or isomerization, which significantly limits the rate. Where such a step is identified, the pseudo first order rate constant of the nucleotide binding step can be lowered by lowering the concentration of nucleotide. In this manner, a system having two slow steps in the phase after product release and through nucleotide binding can be produced by matching the apparent rate constant of nucleotide binding with that the preceding isomerization or translocation event.

Example 4

High Throughput Screen for Polymerase Mutants with Slow Product Release

As described above, polymerases exhibiting slow release of polyphosphate product are of particular interest, e.g., in producing polymerases exhibiting two slow steps for use in single molecule sequencing. Screening polymerase mutants using a stopped-flow assay to determine kinetic parameters, however, can be time-consuming. A higher throughput format for identifying polymerase variants exhibiting slow product release has thus been developed.

In the screen, each candidate polymerase mutant is employed in a primer extension reaction using a DNA template (e.g., a circular DNA template) and four dNTPs or analogs, in the presence or absence of a competitive inhibitor. Nucleotide incorporation is measured based upon elongation rate of the polymerization reaction, as determined from the change in synthesis product size (e.g., as determined by agarose gel electrophoresis).

Figure 19A:
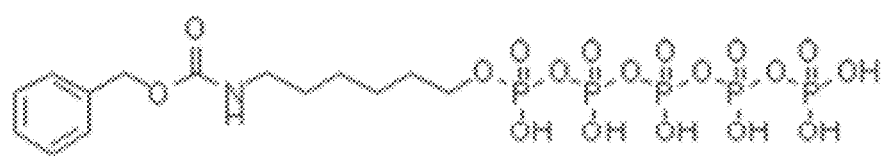
FIG. 19 Panel A depicts the unincorporatable competitive inhibitor Cbz-X-5P. Panels B and C show agarose gels of template dependent, polymerase mediated nucleic acid extension products in the presence of varying concentrations of Cbz-X-5P for two modified Φ29 polymerases.

Suitable competitive inhibitors include, but are not limited to, Z-6-aminohexylpentaphosphate (Cbz-X-5P, FIG. 19 Panel A). Synthesis of Cbz-X-5P has been described in U.S. patent application Ser. No. 12/370,472, which also describes additional exemplary inhibitors. Without limitation to any particular mechanism, Cbz-X-5P mimics the polyphosphate reaction product and competes with dNTP binding, slowing primer extension. The assay is predicated on product affinity as an indication of slow product release; that is, mutants with slower product release are expected to have greater affinity for the competitive inhibitor and thus show a slower extension rate. Candidate mutants identified by the primer extension screen as potentially having decreased product release rates can be verified if desired, e.g., by stopped-flow measurements. The screen is optionally automated or partially automated.

Illustrative results are shown in FIG. 19 Panels B and C. DNA primer extension reactions were carried out using a circular template and a Φ29 polymerase in the presence of 5 µM native nucleotides (dNTPs), MnCl$_2$, ACES pH 7.1, 75 mM potassium acetate, and various concentrations of Cbz-X-5P (0 µM, 60 µM, and 120 µM). Products were analyzed by agarose gel electrophoresis.

As shown in FIG. 19 Panel B, for parental Φ29 polymerase N62D/E375Y/K512Y/T368F, increased concentration of the competitive inhibitor yielded a reduction in the size of the extension product. (A molecular weight standard is shown in the leftmost lane.) As shown in FIG. 19 Panel C, no product for modified Φ29 N62D/E375Y/K512Y/T368F/A484E is seen on inclusion of the competitive inhibitor. The strong inhibition of primer extension by Cbz-X-5P agrees with results of stopped-flow experiments for this mutant.

Example 5

Nucleic Acid Sequencing Using Φ29 Polymerase Mutants Of the Invention

A number of Φ29 polymerase mutants were characterized using single molecule sequencing. These experiments employed a sequencing system in which the polymerase is confined within a zero-mode waveguide (ZMW), and incorporation of fluorescently labeled nucleotide analogs is monitored in real time via an optical system configured to illuminate a plurality of ZMWs on a chip and detect optical signals (corresponding to nucleotide incorporation events) emanating therefrom. See Eid et al. (2009) "Real-time DNA sequencing from single polymerase molecules" Science 323: 133-138 and supplemental information.

For example, in one set of experiments, an enzyme having an L253 mutation was tested under two experimental conditions. In the first experiment, the enzyme was tested with an on-chip control with a 1 kb PhiX174 template and 1 kb All5merA template. In the second experiment, the enzyme was examined with a genomic 2 kB lambda library. The templates were incorporated into SMRTbell circular single stranded templates as described in U.S. Patent No. 2009/0298075. The All5merA template is a synthetic template produced to represent all 5-mer permutations. The results of these studies are provided in Table 20 and indicate consistent activity of this polymerase.

TABLE 20

Single Molecule Sequencing Results

| | N Reads | Median Acc | Median Unrolled Readlength | Mean Unrolled Readlength |
| --- | --- | --- | --- | --- |
| Experiment 1 | 14899 | 84.30% | 1029 | 1115 |
| Experiment 2 | 13991 | 84.10% | 1017 | 1101 |

N Reads refers to the number of sequencing reads per experiment. Median Acc is the median accuracy of the sequences generated by the sequencing system during each study, while readlengths are provided in the two right-most columns. The median and mean readlengths include the reads of the hairpin regions of the SMRTbell templates.

Example 6

Characterization of Exemplary Recombinant Polymerases in Single Molecule Sequencing Reactions Recombinant polymerases based on Φ29 polymerase and including various combinations of mutations were expressed and purified as described below. Polymerase yields were estimated from SYPRO®-stained gels. Activity of the polymerase in solution was assessed in a strand displacement assay. Exemplary yield and activity data are presented in Table 21.

TABLE 21

Yield from high throughput purification procedure (concentration, nM) and strand displacement activity for exemplary recombinant polymerases.

| | Mutations and exogenous features | Activity (nM) | Conc. (nM) |
|---|---|---|---|
| P1 | Btag.His10co.N62D_V250I_L253A_E375Y_A484E_K512Y.co | 183 | 427 |
| P2 | BtagV7co.His10co.CTerm_His10co.Phi29.L253A_E375Y_A484E_K512Y.co | 71 | 278 |
| P3 | Btagco.His10co.CTerm_His10co.Phi29.Y148I_L253A_E375Y_A484E_K512Y.co | 0 | 450 |
| P4 | Btagco.His10co.CTerm_His10co.Phi29.L253A_E375Y_A484E_K512Y_E515K.co | 763 | 4541 |
| P5 | BtagV7co.His10co.CTerm_His10co.Phi29.E239G_L253A_E375Y_A484E_E508R_K512Y.co | 119 | 369 |
| P6 | BtagV7co.His10co.CTerm_His10co.Phi29.Y224K_E239G_L253A_E375Y_A484E_D510K_K512Y.co | 89 | 617 |
| P7 | BtagV7co.His10co.CTerm_His10co.Phi29.Y224K_E239G_L253A_E375Y_A484E_K512Y_F526L.co | 615 | 2312 |
| P8 | BtagV7co.His10co.CTerm_His10co.Phi29.E239G_L253A_E375Y_A484E_D510K_K512Y.co | 41 | 246 |
| P9 | BtagV7co.His10co.CTerm_His10co.Phi29.Y148I_Y224K_E239G_V250I_L253A_E375Y_A484E_D510K_K512Y.co | 193 | 587 |
| P10 | BtagV7co.His10co.CTerm_His10co.Phi29.Y148F_Y224K_E239G_V250I_L253A_E375Y_A484E_D510K_K512Y.co | 314 | 928 |
| P11 | BtagV7co.His10co.CTerm_His10co.Phi29.D12N_Y224K_E239G_L253A_E375Y_A484E_K512Y.co | 1118 | 3103 |
| P12 | BtagV7co.His10co.CTerm_His10co.Phi29.-Y148I_Y224K_E239G_V250I_L253A_E375Y_A484E_E508K_D510K_K512Y.co | 946 | 3283 |
| P13 | BtagV7co.His10co.CTerm_His10co.Phi29.-Y148I_Y224K_E239G_V250I_L253A_E375Y_A484E_D510K_K512Y_E515Q.co | 409 | 1206 |
| P14 | BtagV7co.His10co.CTerm_His10co.Phi29.-N62D_Y148I_Y224K_E239G_V250I_L253A_E375Y_A484E_D510K_K512Y.co | 177 | 677 |
| P15 | BtagV7co.His10co.CTerm_His10co.Phi29.-D66R_Y148I_Y224K_E239G_V250I_L253A_E375Y_A484E_D510K_K512Y.co | 149 | 597 |
| P16 | BtagV7co.His10co.CTerm_His10co.Phi29.-K143R_Y148I_Y224K_E239G_V250I_L253A_E375Y_A484E_D510K_K512Y.co | 134 | 678 |
| P17 | BtagV7co.His10co.CTerm_His10co.Phi29.Y148I_Y224K_E239G_L253C_E375Y_A484E_D510K_K512Y.co | 166 | 1005 |
| P18 | BtagV7co.His10co.CTerm_His10co.Phi29.Y148I_Y224K_E239G_V250I_L253A_E375Y_A484E_D510R_K512Y.co | 282 | 905 |
| P19 | BtagV7co.His10co.CTerm_His10co.Phi29.Y148I_Y224K_E239G_V250I_L253A_E375Y_A484E_D510H_K512Y. co | 476 | 1452 |
| P20 | BtagV7co.His10co.CTerm_His10co.Phi29.L253A_E375Y_A484E_D510K_K512Y.co | * | * |

* Yield of this polymerase (P20) was extremely low; a large scale purification procedure was required instead of the high throughput procedure described below.

The polymerases were further characterized by use in single molecule sequencing. Single molecule sequencing data was obtained with recombinant Φ29 polymerases including the mutation combinations listed in FIG. 35. Exemplary data are presented in Table 22. Data for each polymerase is presented along with data for a control polymerase, acquired from the same chip for comparison. nReads represents the number of ZMWs from which single molecule sequencing data was obtained. Accuracy and readlength are determined using data for those reads meeting selected performance criteria. Readlength is generally correlated with polymerase speed for the short runs performed during initial characterization (five to seven minutes).

TABLE 22

Single molecule sequencing with exemplary recombinant polymerases.

| Pol.[a] | nReads | Read length[b] | Accuracy (%) | Control Pol.[c] | Control nReads | Control Read-length | Control Accuracy |
|---|---|---|---|---|---|---|---|
| P1 | 504 | 266 | 82.2 | P21 | 89 | 244 | 84.46 |
| P2 | 66 | 547 | 88 | P2 | 478 | 384.5 | 87.36 |
| P3 | 64 | 185 | 84.65 | P22 | 266 | 208 | 81.73 |
| P4 | 405 | 263 | 88.11 | P2 | 74 | 254 | 87.7 |
| P5 | 155 | 397 | 86.26 | P2 | 136 | 231 | 84.85 |
| P6 | 380 | 612.5 | 86.4 | P8 | 477 | 478 | 86.24 |
| P7 | 383 | 292 | 83.77 | P2 | 69 | 326 | 82 |
| P8 | 177 | 614 | 84.04 | P8 | 177 | 614 | 84.04 |
| P9 | 255 | 883 | 86.42 | P2 | 319 | 454 | 86.34 |
| P10 | 120 | 786 | 86 | P9 | 448 | 699 | 87 |
| P11 | 517 | 223 | 88 | P2 | 156 | 349 | 87 |
| P12 | 163 | 654 | 85 | P9 | 425 | 577 | 86 |
| P13 | 277 | 278 | 87 | P9 | 187 | 406 | 87 |
| P14 | 177 | 493 | 87 | P9 | 442 | 572 | 86 |
| P15 | 131 | 291 | 89 | P9 | 568 | 493 | 88 |
| P16 | 141 | 510 | 89 | P9 | 522 | 488 | 88 |
| P17 | 196 | 384 | 88 | P9 | 536 | 400 | 88 |
| P18 | 87 | 404 | 89 | P9 | 480 | 276 | 89.17 |
| P19 | 140 | 401 | 89 | P9 | 539 | 330 | 88.4 |
| P20 | 1220[d] | 1926[d] | 83.34[d] | P2 | 2446[d] | 1337[d] | 83.98[d] |

[a]Polymerases are identified as in Table 21.

[b]Readlength in nucleotides.

[c]Additional control polymerases are P21, Btagco.His10co.CTerm_His10.Phi29.N62D_L253A_E375Y_A484E_K512Y.co and P22, Btagco.His10co.CTerm_His10.Phi29.L253A_E375Y_A484E_K512Y.co

[d]Data shown for this polymerase (P20 and control) is from a set of 30 minute movies, rather than a seven minute movie.

Recombinant polymerases based on M2Y polymerase have also been produced and characterized, basically as described for the recombinant Φ29 polymerases. Although tagged wild-type M2Y polymerase failed to sequence under these conditions, as shown in Table 23, an M2Y mutant polymerase including L253A, E375Y, A484E, and K512Y substitutions produced single molecule sequencing data. (Positions are identified relative to wild-type Φ29 polymerase; actual residue numbers in M2Y are 250, 372, 481, and 509. See FIG. 43 for an alignment of the wild-type Φ29 and M2Y polymerase sequences.) The mutant M2Y polymerase was compared to an on-chip control Φ29 polymerase including similar mutations (L253A, E375Y, A484E, and K512Y plus a C-terminal His10 tag).

TABLE 23

Characterization of M2Y recombinant polymerase.

| | Concentration (nM) | Activity (nM) | nReads | Readlength (bases) | Accuracy (%) |
|---|---|---|---|---|---|
| M2Y[a] | 7862 | 2480 | | | |
| mutant M2Y[b] | 4573 | 2250 | 32 | 139 | 88.46 |
| mutant Φ29[c] | | | 109 | 345 | 88.15 |

[a]wild-type M2Y: pET16.BtagV7co.His10co.M2.co
[b]mutant M2Y: pET16.BtagV7co.His10co.M2.L250A_E372Y_A481E_K509Y.co
[c]mutant Φ29 control: pET16.BtagV7co.His10co.CTerm_His10co.Phi29.L253A_E375Y_A484E_K512Y.co Materials and Methods Molecular Cloning The phi29 polymerase gene was cloned into either pET16 or pET11 (Novagen). Primers for specified mutations are designed and introduced into the gene using the Phusion Hot Start DNA Polymerase Kit (New England Biolabs). A PCR reaction is performed to incorporate mutations and product is purified using ZR-96 DNA Clean and Concentration Kits (Zymo Research). PCR products are digested with NdeI/BamHI and ligated into the vector. Plasmids are transformed into TOP10 *E. coli* competent cells, plated on selective media and incubated at 37° C. overnight. Colonies are selected and plasmid is purified using Qiagen miniprep kits. Plasmids are then sequenced (Sequetech).

Protein Purification

Plasmid containing the recombinant phi29 gene is transformed into BL21 Star21 CDE3+Biotin Ligase cells (Invitrogen) using heat shock. Transformed cells are grown in selective media overnight at 37° C. 200 µL of the overnight culture are diluted into 4 mL of Overnight Express Instant TB Medium (EMD Chemicals) and grown at 37° C. until controls reach O.D. value of 4-6. Cultures are then incubated at 18° C. for 16 hours. Following this incubation, cells are harvested, resuspended in buffer, and frozen at −80° C. Cells are thawed and lysed. Following lysis, cells are centrifuged and supernatant is collected. Polymerase is purified over nickel followed by heparin columns. The resulting proteins are run on gels and quantified by SYPRO® staining.

Single Molecule Sequencing

Enzymes are characterized by single molecule sequencing basically as described in Eid et al. (2009) Science 323:133-138 (including supplemental information), using commercially available reagents (from SMRT™ sequencing kits, Pacific Biosciences of California, Inc.). Each enzyme is initially screened with a single 5-7 minute movie, followed by secondary screening with 30 minute replicates where applicable. Enzymes are evaluated, e.g., based on readlength and accuracy compared to control enzymes.

While the foregoing invention has been described in some detail for purposes of clarity and understanding, it will be clear to one skilled in the art from a reading of this disclosure that various changes in form and detail can be made without departing from the true scope of the invention. For example, all the techniques and apparatus described above can be used in various combinations. All publications, patents, patent applications, and/or other documents cited in this application are incorporated by reference in their entirety for all purposes to the same extent as if each individual publication, patent, patent application, and/or other document were individually indicated to be incorporated by reference for all purposes.

SEQUENCE LISTING (200 sequences)

SEQ ID NO: 1 - protein, 575 aa, Bacteriophage phi-29 [sequence omitted]

SEQ ID NO: 2 - protein, 572 aa, Bacteriophage M2Y
MSRKMFSCDFETTTKLDDCRVWAYGYMEIGNLDNYKIGNSLDEFMQWVMEIQADLYFHNLKFDGAFIVNWLEQHGFKWSNEGLPNTYNTIISKMGQWYMIDICFGYKGKRKLHTVIYDSLKKLPFPVKKIAKDFQLPLLKGDIDYHTERPVGHEITPEEYEYIKNDIEIIARALDIQFKQGLDRMTAGSDSLKGFKDILSTKKFNKVFPKLSLPMDKEIRKAYRGGFTWLNDKYKEKEIGEGMVFDVNSLYPSQMYSRPLPYGAPIVFQGKYEKDEQYPLYIQRIRFEFELKEGYIPTIQIKKNPFFKGNEYLKNSGVEPVELYLTNVDLELIQEHYELYNVEYIDGFKFREKTGLFKDFIDKWTYVKTHEEGAKKQLAKLMLNSLYGKFASNPDVTGKVPYLKDDGSLGFRVGDEEYKDPVYTPMGVFITAWARFTTITAAQACYDRIIYCDTDSIHLTGTEVPEIIKDIVDPKKLGYWAHESTFKRAKYLRQKTYIQDIYVKEVDGKLKECSPDEATTTKFSVKCAGMTDTIKKKVTFDNFAVGFSSMGKPKPVQVNGGVVLVDSVFTIK

SEQ ID NO: 3 - protein, 572 aa, Bacteriophage B103
MPRKMFSCDFETTTKLDDCRVWAYGYMEIGNLDNYKIGNSLDEFMQWVMEIQADLYFHNLKFDGAFIVNWLEHHGFKWSNEGLPNTYNTIISKMGQWYMIDICFGYKGKRKLHTVIYDSLKKLPFPVKKIAKDFQLPLLKGDIDYHAERPVGHEITPEEYEYIKNDIEIIARALDIQFKQGLDRMTAGSDSLKGFKDILSTKKFNKVFPKLSLPMDKEIRRAYRGGFTWLNDKYKEKEIGEGMVFDVNSLYPSQMYSRPLPYGAPIVFQGKYEKDEQYPLYIQRIRFEFELKEGYIPTIQIKKNPFFKGNEYLKNSGAEPVELYLTNVDLELIQEHYEMYNVEYIDGFKFREKTGLFKEFIDKWTYVKTHEKGAKKQLAKLMFDSLYGKFASNPDVTGKVPYLKEDGSLGFRVGDEEYKDPVYTPMGVFITAWARFTTITAAQACYDRIIYCDTDSIHLTGTEVPEIIKDIVDPKKLGYWAHESTFKRAKYLRQKTYIQDIYAKEVDGKLIECSPDEATTTKFSVKCAGMTDTIKKKVTFDNFRVGFSSTGKPKPVQVNGGVVLVDSVFTIK

SEQ ID NO: 4 - protein, 578 aa, Bacteriophage GA-1
MARSVYVCDFETTTDPEDCRLWAWGWMDIYNTDKWSYGEDIDSFMEWALNSNSDIYFHNLKFDGSFILPWWLRNGYVHTEEDRTNTPKEFTTTISGMGQWYAVDVCINTRGKNKNHVVFYDSLKKLPFKVEQIAKGFGLPVLKGDIDYKKYRPVGYVMDDNEIEYLKHDLLIVALALRSMFDNDFTSMTVGSDALNTYKEMLGVKQWEKYFPVLSLKVNSEIRKAYKGGFTWVNPKYQGETVYGGMVFDVNSMYPAMMKNKLLPYGEPVMFKGEYKKNVEYPLYIQQVRCFFELKKDKIPCIQIKGNARFGQNEYLSTSGDEYVDLYVTNVDWELIKKHYDIFEEEFIGGFMFKGFIGFFDEYIDRFMEIKNSPDSSAEQSLQAKLMLNSLYGKFATNPDITGKVPYLDENGVLKFRKGELKERDPVYTPMGCFITAYARENILSNAQKLYPRFIYADTDSIHVEGLGEVDAIKDVIDPKKLGYWDHEATFQRARYVRQKTYFIETTWKENDKGKLVVCEPQDATKVKPKIACAGMSDAIKERIRFNEFKIGYSTHGSLKPKNVLGGVVLMDYPFAIK

SEQ ID NO: 5 - protein, 566 aa, Bacteriophage AV-1
MVRQSTIASPARGGVRRSHKKVPSFCADFETTTDEDDCRVWSWGIIQVGKLQNYVDGISLDGFMSHISERASHIYFHNLAFDGTFILDWLLKHGYRWTKENPGVKEFTSLISRMGKYYSITVVFETGFRVEFRDSFKKLPMSVSAIAKAFNLHDQKLEIDYEKPRPIGYIPTEQEKRYQRNDVAIVAQALEVQFAEKMTKLTAGSDSLATYKKMTGKLFIRRFPILSPEIDTEIRKAYRGGFTYADPRYAKKLNGKGSVYDVNSLYPSVMRTALLPYGEPIYSEGAPRTNRPLYIASITFTAKLKPNHIPCIQIKKNLSFNPTQYLEEVKEPTTVVATNIDIELWKKHYDFKIYSWNGTFEFRGSHGFFDTYVDHFMEIKKNSTGGLRQIAKLHLNSLYGKFATNPDITGKHPTLKDNRVSLVMNEPETRDPVYTPMGVFITAYARKKTISAAQDNYETFAYADTDSLHLIGPTTPPDSLWVDPVELGAWKHESSFTKSVYIRAKQYAEEIGGKLDVHIAGMPRNVAATLTLEDMLHGGTWNGKLIPVRVPGGTVLKDTTFTLKID

SEQ ID NO: 6 - protein, 568 aa, Bacteriophage CP-1
MTCYYAGDFETTTNEEETEVWLSCFAKVIDYDKLDTFKVNTSLEDFLKSLYLDLDKTYTETGEDEFIIFFHNLKFDGSFLLSFFLNNDIECTYFINDMGVWYSITLEFPDFTLTFRDSLKILNFSIATMAGLFKMPIAKGTTPLLKHKPEVIKPEWIDYIHVDVAILARGIFAMYYEENFTKYTSASEALTEFKRIFRKSKRKFRDFFPILDEKVDDFCRKHIVGAGRLPTLKHRGRTLNQLIDIYDINSMYPATMLQNALPIGIPKRYKGKPKEIKEDHYYIYHIKADFDLKRGYLPTIQIKKKLDALRIGVRTSDYVTTSKNEVIDLYLTNFDLDLFLKHYDATIMYVETLEFQTESDLFDDYITTYRYKKENAQSPAEKQKAKIMLNSLYGKFGAKIISVKKLAYLDDKGILRFKNDDEEEVQPVYAPVALFVTSIARHFIISNAQENYDNFLYADTDSLHLFHSDSLVLDIDPSEFGKWAHEGRAVKAKYLRSKLYIEELIQEDGTTHLDVKGAGMTPEIKEKITFENFVIGATFEGKRASKQIKGGTLIYETTFKIRETDYLV

SEQ ID NO: 7 - protein, 218 aa, Artificial
  polypeptide tag
MSPILGYWKIKGLVQPTRLLLEYLEEKYEEHLYERDEGDKWRNKKFELGLEFPNLPYYIDGDVKLTQSMAIIRYIADKHNMLGGCPKERAEISMLEGAVLDIRYGVSRIAYSKDFETLKVDFLSKLPEMLKMFEDRLCHKTYLNGDHVTHPDFMLYDALDVVLYMDPMCLDAFPKLVCFKKRIEAIPQIDKYLKSSKYIAWPLQGWQATFGGGDHPPK

SEQ ID NO: 8 - protein, 4 aa, Artificial
  polypeptide linker protease cleavage site
IEGR

SEQ ID NO: 9 - protein, 15 aa, Artificial
  polypeptide tag
GLNDIFEAQKIEWHE

SEQ ID NO: 10 - protein, 15 aa, Artificial
  polypeptide tag
GLNDLFHAQKIEWHE

SEQ ID NO: 11 - protein, 15 aa, Artificial
  polypeptide tag
GLNDFFNAQKIEWHE

SEQ ID NO: 12 - protein, 15 aa, Artificial
  polypeptide tag
GINDLFSAQKIEWHE

SEQ ID NO: 13 - protein, 15 aa, Artificial
  polypeptide tag
GINDIFEAQKIEWHE

SEQ ID NO: 14 - protein, 15 aa, Artificial
  polypeptide tag
GLNLIFEAQKIEWHE

SEQ ID NO: 15 - protein, 15 aa, Artificial
  polypeptide tag
GLNDLFEAQKIEWHE

SEQ ID NO: 16 - protein, 15 aa, Artificial
  polypeptide tag
GLNDFFEAQKIEWHE

SEQ ID NO: 17 - protein, 15 aa, Artificial
  polypeptide tag
GLNDIVEAQKIEWHE

SEQ ID NO: 18 - protein, 15 aa, Artificial
  polypeptide tag
GLNDIFHAQKIEWHE

SEQ ID NO: 19 - protein, 15 aa, Artificial
  polypeptide tag
GLNDIFNAQKIEWHE

SEQ ID NO: 20 - protein, 15 aa, Artificial
  polypeptide tag
GLNDIFSAQKIEWHE

SEQ ID NO: 21 - protein, 15 aa, Artificial
  polypeptide tag
DVEAWLGARVPLVET

SEQ ID NO: 22 - protein, 13 aa, Artificial
  polypeptide tag
GSGAAAAAAAAAH

SEQ ID NO: 23 - protein, 13 aa, Artificial
  polypeptide linker
GGSGGGSGGGSGG

SEQ ID NO: 24 - protein, 10 aa, Artificial
  polypeptide tag
AAAAAAAAAA

SEQ ID NO: 25 - protein, 13 aa, Artificial
  polypeptide tag
GRKKRRQRRRPPQ

SEQ ID NO: 26 - protein, 10 aa, Artificial
  polypeptide tag
KKKKKKKKKK

SEQ ID NO: 27 - protein, 13 aa, Artificial
  polypeptide tag
GSGAAAAAAAAHH

SEQ ID NO: 28 - protein, 13 aa, Artificial
  polypeptide tag
GSGAAAAAAAHHH

SEQ ID NO: 29 - protein, 10 aa, Artificial
  polypeptide tag
EQKLISEEDL

SEQ ID NO: 30 - protein, 64 aa, Artificial
  polypeptide tag
MATVKFKYKGEEKEVDISKIKKVWRVGKMISFTYDEGGGKTGRGAVSEKDAPKELLQMLEKQKK

SEQ ID NO: 31 - protein, 7 aa, Artificial
  polypeptide tag
GHHHHHH

SEQ ID NO: 32 - protein, 8 aa, Artificial
  polypeptide tag
GHHHHHHH

SEQ ID NO: 33 - protein, 9 aa, Artificial
  polypeptide tag
GHHHHHHHH

SEQ ID NO: 34 - protein, 10 aa, Artificial
  polypeptide tag
GHHHHHHHHH

SEQ ID NO: 35 - protein, 11 aa, Artificial
  polypeptide tag
GHHHHHHHHHH

SEQ ID NO: 36 - protein, 12 aa, Artificial
  polypeptide tag
GHHHHHHHHHHH

SEQ ID NO: 37 - protein, 13 aa, Artificial
  polypeptide tag
GHHHHHHHHHHHH

SEQ ID NO: 38 - protein, 14 aa, Artificial
  polypeptide tag
GHHHHHHHHHHHHH

SEQ ID NO: 39 - protein, 15 aa, Artificial
  polypeptide tag
GHHHHHHHHHHHHHH

SEQ ID NO: 40 - protein, 16 aa, Artificial
  polypeptide tag
GHHHHHHHHHHHHHHH

SEQ ID NO: 41 - protein, 17 aa, Artificial
  polypeptide tag
GHHHHHHHHHHHHHHHH

SEQ ID NO: 42 - protein, 18 aa, Artificial
  polypeptide tag
GHHHHHHHHHHHHHHHHH

SEQ ID NO: 43 - protein, 19 aa, Artificial
  polypeptide tag
GHHHHHHHHHHHHHHHHHH

SEQ ID NO: 44 - protein, 20 aa, Artificial
  polypeptide tag
GHHHHHHHHHHHHHHHHHHH

SEQ ID NO: 45 - protein, 21 aa, Artificial
  polypeptide tag
GHHHHHHHHHHHHHHHHHHHH

SEQ ID NO: 46 - protein, 22 aa, Artificial
  polypeptide tag
GHHHHHHHHHHHHHHHHHHHHH

SEQ ID NO: 47 - protein, 23 aa, Artificial
  polypeptide tag
GHHHHHHHHHHHHHHHHHHHHHH

SEQ ID NO: 48 - protein, 24 aa, Artificial
  polypeptide tag
GHHHHHHHHHHHHHHHHHHHHHHH

SEQ ID NO: 49 - protein, 25 aa, Artificial
  polypeptide tag
GHHHHHHHHHHHHHHHHHHHHHHHH

SEQ ID NO: 50 - protein, 17 aa, Artificial
  polypeptide tag
GAAAAAAAAAAAAAAAA

SEQ ID NO: 51 - protein, 616 aa, Artificial
  mutant recombinant phi29-type DNA polymerase
MSVDGLNDIFEAQKIEWHEAMGHHHHHHHHHHSSGHIEGRHMKHMPRKMYSCDFETTTKVEDCRVWAYGYMNIEDHSEYKIGNSLDEFMAWVLKVQADLYFHDLKFDGAFIINWLERNGFKWSADGLPNTYNTIISRMGQWYMIDICLGYKGKRKIHTVIYDSLKKLPFPVKKIAKDFKLTVLKGDIDYHKERPVGYKITPEEYAYIKNDIQIIAEALLIQFKQGLDRMTAGSDSLKGFKDIITTKKFKKVFPTLSLGLDKEVRYAYRGGFTWLNDRFKEKEIGEGMVFDVNSLYPAQMYSRLLPYGEPIVFEGKYVWDEDYPLHIQHIRCEFELKEGYIPTIQIKRSRFYKGNEYLKSSGGEIADLWLSNVDLELMKEHYDLYNVEYISGLKFKATTGLFKDFIDKWTYIKTTSYGAIKQLAKLMLNSLYGKFASNPDVTGKVPYLKENGALGFRLGEEETKDPVYTPMGVFITAWARYTTITAAQACYDRIIYCDTDSIHLTGTEIPDVIKDIVDPKKLGYWAHESTFKRAKYLRQKTYIQDIYMKEVDGYLVEGSPDDYTDIKFSVKCAGMTDKIKKEVTFENFKVGFSRKMKPKPVQVPGGVVLVDDTFTIK

SEQ ID NO: 52 - protein, 616 aa, Artificial
  mutant recombinant phi29-type DNA polymerase
MSVDGLNDIFEAQKIEWHEAMGHHHHHHHHHHSSGHIEGRHMKHMPRKMYSCDFETTTKVEDCRVWAYGYMNIEDHSEYKIGNSLDEFMAWVLKVQADLYFHDLKFDGAFIINWLERNGFKWSADGLPNTYNTIISRMGQWYMIDICLGYKGKRKIHTVIYDSLKKLPFPVKKIAKDFKLTVLKGDIDYHKERPVGYKITPEEYAYIKNDIQIIAEALLIQFKQGLDRMTAGSDSLKGFKDIITTKKFKKVFPTLSLGLDKEVRYAYRGGFTWLNDRFKEKEIGEGMVFDVNSLYPAQMYSRLLPYGEPIVFEGKYVWDEDYPLHIQHIRCEFELKEGYIPTIQIKRSRFYKGNEYLKSSGGEIADLWLSNVDLELMKEHYDLYNVEYISGLKFKATTGLFKDFIDKWFYIKTTSYGAIKQLAKLMLNSLYGKFASNPDVTGKVPYLKENGALGFRLGEEETKDPVYTPMGVFITAWARYTTITAAQACYDRIIYCDTDSIHLTGTEIPDVIKDIVDPKKLGYWAHESTFKRAKYLRQKTYIQDIYMKEVDGYLVEGSPDDYTDIKFSVKCAGMTDKIKKEVTFENFKVGFSRKMKPKPVQVPGGVVLVDDTFTIK

SEQ ID NO: 53 - protein, 616 aa, Artificial; identical to SEQ ID NO: 52
  mutant recombinant phi29-type DNA polymerase

SEQ ID NO: 54 - protein, 616 aa, Artificial
  mutant recombinant phi29-type DNA polymerase
MSVDGLNDIFEAQKIEWHEAMGHHHHHHHHHHSSGHIEGRHMKHMPRKMYSCDFETTTKVEDCRVWAYGYMNIEDHSEYKIGNSLDEFMAWVLKVQADLYFHNLKFDGAFIINWLERNGFKWSADGLPNTYNTIISRMGQWYMIDICLGYKGKRKIHTVIYDSLKKLPFPVKKIAKDFKLTVLKGDIDYHKERPVGYKITPEEYAYIKNDIQIIAEALLIQFKQGLDRMTAGSDSLKGFKDIITTKKFKKVFPTLSLGLDKEVRYAYRGGFTWLNDRFKEKEIGEGMVFDVNSLYPAQMYSRLLPYGEPIVFEGKYVWDEDYPLHIQHIRCEFELKEGYIPTIQIKRSRFYKGNEYLKSSGGEIADLWLSNVDLELMKEHYDLYNVEYISGLKFKATTGLFKDFIDKWFYIKTTSYGAIKQLAKLMLNSLYGKFASNPDVTGKVPYLKENGALGFRLGEEETKDPVYTPMGVFITAWARYTTITAAQACYDRIIYCDTDSIHLTGTEIPDVIKDIVDPKKLGYWAHESTFKRAKYLRQKTYIQDIYMKEVDGYLVEGSPDDYTDIKFSVKCAGMTDKIKKEVTFENFKVGFSRKMKPKPVQVPGGVVLVDDTFTIK

SEQ ID NO: 55 - protein, 616 aa, Artificial
  mutant recombinant phi29-type DNA polymerase
MSVDGLNDIFEAQKIEWHEAMGHHHHHHHHHHSSGHIEGRHMKHMPRKMYSCDFETTTKVEDCRVWAYGYMNIEDHSEYKIGNSLDEFMAWVLKVQADLYFHDLKFDGAFIINWLERNGFKWSADGLPNTYNTIISRMGQWYMIDICLGYKGKRKIHTVIYDSLKKLPFPVKKIAKDFKLTVLKGDIDYHKERPVGYKITPEEYAYIKNDIQIIAEALLIQFKQGLDRMTAGSDSLKGFKDIITTKKFKKVFPTLSLGLDKEVRYAYRGGFTWLNDRFKEKEIGEGMVFDVNSAYPAQMYSRLLPYGEPIVFEGKYVWDEDYPLHIQHIRCEFELKEGYIPTIQIKRSRFYKGNEYLKSSGGEIADLWLSNVDLELMKEHYDLYNVEYISGLKFKATTGLFKDFIDKWTYIKTTSYGAIKQLAKLMLNSLYGKFASNPDVTGKVPYLKENGALGFRLGEEETKDPVYTPMGVFITAWARYTTITAAQACYDRIIYCDTDSIHLTGTEIPDVIKDIVDPKKLGYWEHESTFKRAKYLRQKTYIQDIYMKEVDGYLVEGSPDDYTDIKFSVKCAGMTDKIKKEVTFENFKVGFSRKMKPKPVQVPGGVVLVDDTFTIK

SEQ ID NO: 56 - protein, 616 aa, Artificial
  mutant recombinant phi29-type DNA polymerase
MSVDGLNDIFEAQKIEWHEAMGHHHHHHHHHHSSGHIEGRHMKHMPRKMYSCDFETTTKVEDCRVWAYGYMNIEDHSEYKIGNSLDEFMAWVLKVQADLYFHDLKFDGAFIINWLERNGFKWSADGLPNTYNTIISRMGQWYMIDICLGYKGKRKIHTVIYDSLKKLPFPVKKIAKDFKLTVLKGDIDYHKERPVGYKITPEEYAYIKNDIQIIAEALLIQFKQGLDRMTAGSDSLKGFKDIITTKKFKKVFPTLSLGLDKEVRYAYRGGFTWLNDRFKEKEIGEGMVFDVNSAYPAQMYSRLLPYGEPIVFEGKYVWDEDYPLHIQHIRCEFELKEGYIPTIQIKRSRFYKGNEYLKSSGGEIADLWLSNVDLELMKEHYDLYNVEYISGLKFKATTGLFKDFIDKWTYIKTTSYGAIKQLAKLMLNSLYGKFASNPDVTGKVPYLKENGALGFRLGEEETKDPVYTPMGVFITAWARYTTITAAQACYDRIIYCDTDSIHLTGTEIPDVIKDIVDPKKLGYWAHESTFKRAKYLRQKTYIQDIYMKEVDGYLVEGSPDDYTDIKFSVKCAGMTDKIKKEVTFENFKVGFSRKMKPKPVQVPGGVVLVDDTFTIK

SEQ ID NO: 57 - protein, 627 aa, Artificial
  mutant recombinant phi29-type DNA polymerase
MSVDGLNDIFEAQKIEWHEAMGHHHHHHHHHHSSGHIEGRHMKHMPRKMYSCDFETTTKVEDCRVWAYGYMNIEDHSEYKIGNSLDEFMAWVLKVQADLYFHDLKFDGAFIINWLERNGFKWSADGLPNTYNTIISRMGQWYMIDICLGYKGKRKIHTVIYDSLKKLPFPVKKIAKDFKLTVLKGDIDYHKERPVGYKITPEEYAYIKNDIQIIAEALLIQFKQGLDRMTAGSDSLKGFKDIITTKKFKKVFPTLSLGLDKEVRYAYRGGFTWLNDRFKEKEIGEGMVFDVNSLYPAQMYSRLLPYGEPIVFEGKYVWDEDYPLHIQHIRCEFELKEGYIPTIQIKRSRFYKGNEYLKSSGGEIADLWLSNVDLELMKEHYDLYNVEYISGLKFKATTGLFKDFIDKWFYIKTTSYGAIKQLAKLMLNSLYGKFASNPDVTGKVPYLKENGALGFRLGEEETKDPVYTPMGVFITAWARYTTITAAQACYDRIIYCDTDSIHLTGTEIPDVIKDIVDPKKLGYWEHESTFKRAKYLRQKTYIQDIYMKEVDGYLVEGSPDDYTDIKFSVKCAGMTDKIKKEVTFENFKVGFSRKMKPKPVQVPGGVVLVDDTFTIKGHHHHHHHHHH

SEQ ID NO: 58 - protein, 616 aa, Artificial
  mutant recombinant phi29-type DNA polymerase
MSVDGLNDIFEAQKIEWHEAMGHHHHHHHHHHSSGHIEGRHMKHMPRKMYSCDFETTTKVEDCRVWAYGYMNIEDHSEYKIGNSLDEFMAWVLKVQADLYFHDLKFDGAFIINWLERNGFKWSADGLPNTYNTIISRMGQWYMIDICLGYKGKRKIHTVIYDSLKKLPFPVKKIAKDFKLTVLKGDIDYHKERPVGYKITPEEYAYIKNDIQIIAEALLIQFKQGLDRMTAGSDSLKGFKDIITTKKFKKVFPTLSLGLDKEVRYAYRGGFTWLNDRFKEKEIGEGMVFDVNSLYPAQMYSRLLPYGEPIVFEGKYVWDEDYPLHIQHIRCEFELKEGYIPTIQIKRSRFYKGNEYLKSSGGEIADLWLSNVDLELMKEHYDLYNVEYISGLKFKATTGLFKDFIDKWFYIKTTSYGAIKQLAKLMLNSLYGKFASNPDVTGKVPYLKENGALGFRLGEEETKDPVYTPMGVFITAWARYTTITAAQACYDRIIYCDTDSIHLTGTEIPDVIKDIVDPKKLGYWEHESTFKRAKYLRQKTYIQDIYMKEVDGYLVEGSPDDYTDIKFSVKCAGMTDKIKKEVTFENFKVGFSRKMKPKPVQVPGGVVLVDDTFTIK

SEQ ID NO: 59 - protein, 627 aa, Artificial
  mutant recombinant phi29-type DNA polymerase
MSVDGLNDIFEAQKIEWHEAMGHHHHHHHHHHSSGHIEGRHMKHMPRKMYSCDFETTTKVEDCRVWAYGYMNIEDHSEYKIGNSLDEFMAWVLKVQADLYFHDLKFDGAFIINWLERNGFKWSADGLPNTYNTIISRMGQWYMIDICLGYKGKRKIHTVIYDSLKKLPFPVKKIAKDFKLTVLKGDIDYHKERPVGYKITPEEYAYIKNDIQIIAEALLIQFKQGLDRMTAGSDSLKGFKDIITTKKFKKVFPTLSLGLDKEVRYAYRGGFTWLNDRFKEKEIGEGMVFDVNSAYPAQMYSRLLPYGEPIVFEGKYVWDEDYPLHIQHIRCEFELKEGYIPTIQIKRSRFYKGNEYLKSSGGEIADLWLSNVDLELMKEHYDLYNVEYISGLKFKATTGLFKDFIDKWTYIKTTSYGAIKQLAKLMLNSLYGKFASNPDVTGKVPYLKENGALGFRLGEEETKDPVYTPMGVFITAWARYTTITAAQACYDRIIYCDTDSIHLTGTEIPDVIKDIVDPKKLGYWEHESTFKRAKYLRQKTYIQDIYMKEVDGYLVEGSPDDYTDIKFSVKCAGMTDKIKKEVTFENFKVGFSRKMKPKPVQVPGGVVLVDDTFTIKGHHHHHHHHHH

SEQ ID NO: 60 - protein, 639 aa, Artificial
  mutant recombinant phi29-type DNA polymerase
MSVDGLNDIFEAQKIEWHEAMGHHHHHHHHHHSSGHIEGRHMKHMPRKMYSCDFETTTKVEDCRVWAYGYMNIEDHSEYKIGNSLDEFMAWVLKVQADLYFHDLKFDGAFIINWLERNGFKWSADGLPNTYNTIISRMGQWYMIDICLGYKGKRKIHTVIYDSLKKLPFPVKKIAKDFKLTVLKGDIDYHKERPVGYKITPEEYAYIKNDIQIIAEALLIQFKQGLDRMTAGSDSLKGFKDIITTKKFKKVFPTLSLGLDKEVRYAYRGGFTWLNDRFKEKEIGEGMVFDVNSAYPAQMYSRLLPYGEPIVFEGKYVWDEDYPLHIQHIRCEFELKEGYIPTIQIKRSRFYKGNEYLKSSGGEIADLWLSNVDLELMKEHYDLYNVEYISGLKFKATTGLFKDFIDKWTYIKTTSYGAIKQLAKLMLNSLYGKFASNPDVTGKVPYLKENGALGFRLGEEETKDPVYTPMGVFITAWARYTTITAAQACYDRIIYCDTDSIHLTGTEIPDVIKDIVDPKKLGYWEHESTFKRAKYLRQKTYIQDIYMKEVDGYLVEGSPDDYTDIKFSVKCAGMTDKIKKEVTFENFKVGFSRKMKPKPVQVPGGVVLVDDTFTIKGGSGGGLGGGLGGAAAAAAAAAA

SEQ ID NO: 61 - protein, 616 aa, Artificial
  mutant recombinant phi29-type DNA polymerase
MSVDGLNDIFEAQKIEWHEAMGHHHHHHHHHHSSGHIEGRHMKHMPRKMYSCDFETTTKVEDCRVWAYGYMNIEDHSEYKIGNSLDEFMAWVLKVQADLYFHDLKFDGAFIINWLERNGFKWSADGLPNTYNTIISRMGQWYMIDICLGYKGKRKIHTVIYDSLKKLPFPVKKIAKDFKLTVLKGDIDYMKERPVGYKITPEEYAYIKNDIQIIAEALLIQFKQGLDRMTAGSDSLKGFKDIITTKKFKKVFPTLSLGLDKEVRYAYRGGFTWLNDRFKEKEIGEGMVFDVNSLYPAQMYSRLLPYGEPIVFEGKYVWDEDYPLHIQHIRCEFELKEGYIPTIQIKRSRFYKGNEYLKSSGGEIADLWLSNVDLELMKEHYDLYNVEYISGLKFKATTGLFKDFIDKWFYIKTTSYGAIKQLAKLMLNSLYGKFASNPDVTGKVPYLKENGALGFRLGEEETKDPVYTPMGVFITAWARYTTITAAQACYDRIIYCDTDSIHLTGTEIPDVIKDIVDPKKLGYWAHESTFKRAKYLRQKTYIQDIYMKEVMGYLVEGSPDDYTMIKFSVKCAGMTDKIKKEVTFENFKVGFSRKMKPKPVQVPGGVVLVDDTFTIK

SEQ ID NO: 62 - protein, 627 aa, Artificial
  mutant recombinant phi29-type DNA polymerase
MSVDGLNDIFEAQKIEWHEAMGHHHHHHHHHHSSGHIEGRHMKHMPRKMYSCDFETTTKVEDCRVWAYGYMNIEDHSEYKIGNSLDEFMAWVLKVQADLYFHHLKFDGAFIINWLERNGFKWSADGLPNTYNTIISRMGQWYMIDICLGYKGKRKIHTVIYDSLKKLPFPVKKIAKDFKLTVLKGDIDYHKERPVGYKITPEEYAYIKNDIQIIAEALLIQFKQGLDRMTAGSDSLKGFKDIITTKKFKKVFPTLSLGLDKEVRYAYRGGFTWLNDRFKEKEIGEGMVFDVNSLYPAQMYSRLLPYGEPIVFEGKYVWDEDYPLHIQHIRCEFELKEGYIPTIQIKRSRFYKGNEYLKSSGGEIADLWLSNVDLELMKEHYDLYNVEYISGLKFKATTGLFKDFIDKWTYIKTTSYGAIKQLAKLMLNSLYGKFASNPDVTGKVPYLKENGALGFRLGEEETKDPVYTPMGVFITAWARYTTITAAQACYDRIIYCDTDSIHLTGTEIPDVIKDIVDPKKLGYWEHESTFKRAKYLRQKTYIQDIYMKRVDGYLVEGSPDDYTDIKFSVKCAGMTDKIKKEVTFENFKVGFSRKMKPKPVQVPGGVVLVDDTFTIKGHHHHHHHHHH

SEQ ID NO: 63 - protein, 627 aa, Artificial
  mutant recombinant phi29-type DNA polymerase
MSVDGLNDIFEAQKIEWHEAMGHHHHHHHHHHSSGHIEGRHMKHMPRKMYSCRFETTTKVEDCRVWAYGYMNIEDHSEYKIGNSLDEFMAWVLKVQADLYFHHLKFDGAFIINWLERNGFKWSADGLPNTYNTIISRMGQWYMIDICLGYKGKRKIHTVIYDSLKKLPFPVKKIAKDFKLTVLKGDIDYHKERPVGYKITPEEYAYIKNDIQIIAEALLIQFKQGLDRMTAGSDSLKGFKDIITTKKFKKVFPTLSLGLDKEVRYAYRGGFTWLNDRFKEKEIGEGMVFDVNSLYPAQMYSRLLPYGEPIVFEGKYVWDEDYPLHIQHIRCEFELKEGYIPTIQIKRSRFYKGNEYLKSSGGEIADLWLSNVDLELMKEHYDLYNVEYISGLKFKATTGLFKDFIDKWFYIKTTSYGAIKQLAKLMLNSLYGKFASNPDVTGKVPYLKENGALGFRLGEEETKDPVYTPMGVFITAWARYTTITAAQACYDRIIYCDTDSIHLTGTEIPDVIKDIVDPKKLGYWEHESTFKRAKYLRQKTYIQDIYMKEVDGYLVEGSPDDYTDIKFSVKCAGMTDKIKKEVTFENFKVGFSRKMKPKPVQVPGGVVLVDDTFTIKGHHHHHHHHHH

SEQ ID NO: 64 - protein, 631 aa, Artificial
  mutant recombinant phi29-type DNA polymerase
MSVDGLNDIFEAQKIEWHEAMGHHHHHHHHHHSSGHIEGRHMKHMPRKMYSCRFETTTKVEDCRVWAYGYMNIEDHSEYKIGNSLDEFMAWVLKVQADLYFHNLKFDGAFIINWLERNGFKWSADGLPNTYNTIISRMGQWYMIDICLGYKGKRKIHTVIYDSLKKLPFPVKKIAKDFKLTVLKGDIDYHKERPVGYKITPEEYAYIKNDIQIIAEALLIQFKQGLDRMTAGSDSLKGFKDIITTKKFKKVFPTLSLGLDKEVRYAYRGGFTWLNDRFKEKEIGEGMVFDVNSLYPAQMYSRLLPYGEPIVFEGKYVWDEDYPLHIQHIRCEFELKEGYIPTIQIKRSRFYKGNEYLKSSGGEIADLWLSNVDLELMKEHYDLYNVEYISGLKFKATTGLFKDFIDKWFYIKTTSYGAIKQLAKLMLNSLYGKFASNPDVTGKVPYLKENGALGFRLGEEETKDPVYTPMGVFITAWARYTTITAAQACYDRIIYCDTDSIHLTGTEIPDVIKDIVDPKKLGYWEHESTFKRAKYLRQKTYIQDIYMKRVDGKSKGSLVEGSPDDYTDIKFSVKCAGMTDKIKKEVTFENFKVGFSRKMKPKPVQVPGGVVLVDDTFTIKGHHHHHHHHHH

SEQ ID NO: 65 - protein, 631 aa, Artificial
  mutant recombinant phi29-type DNA polymerase
MSVDGLNDIFEAQKIEWHEAMGHHHHHHHHHHSSGHIEGRHMKHMPRKMYSCRFETTTKVEDCRVWAYGYMNIEDHSEYKIGNSLDEFMAWVLKVQADLYFHNLKFDGAFIINWLERNGFKWSADGLPNTYNTIISRMGQWYMIDICLGYKGKRKIHTVIYDSLKKLPFPVKKIAKDFKLTVLKGDIDYHKERPVGYKITPEEYAYIKNDIQIIAEALLIQFKQGLDRMTAGSDSLKGFKDIITTKKFKKVFPTLSLGLDKEVRYAYRGGFTWLNDRFKEKEIGEGMVFDVNSLYPAQMYSRLLPYGEPIVFEGKYVWDEDYPLHIQHIRCEFELKEGYIPTIQIKRSRFYKGNEYLKSSGGEIADLWLSNVDLELMKEHYDLYNVEYISGLKFKATTGLFKDFIDKWFYIKTTSYGAWKQLAKLMLNSLYGKFASNPDVTGKVPYLKENGALGFRLGEEETKDPVYTPMGVFITAWARYTTITAAQACYDRIIYCDTDSIHLTGTEIPDVIKDIVDPKKLGYWEHESTFKRAKYLRQKTYIQDIYMKRVDGKSKGSLVEGSPDDYTDIKFSVKCAGMTDKIKKEVTFENFKVGFSRKMKPKPVQVPGGVVLVDDTFTIKGHHHHHHHHHH

SEQ ID NO: 66 - protein, 616 aa, Artificial
  mutant recombinant phi29-type DNA polymerase
MSVDGLNDIFEAQKIEWHEAMGHHHHHHHHHHSSGHIEGRHMKHMPRKMYSCDFETTTKVEDCRVWAYGYMNIEDHSEYKIGNSLDEFMAWVLKVQADLYFHNLKFDGAFIINWLERNGFKWSADGLPNTYNTIISRMGQWYMIDICLGYKGKRKIHTVIYDSLKKLPFPVKKIAKDFKLTVLKGDIDAHKERPVGYKITPEEYAYIKNDIQIIAEALLIQFKQGLDRMTAGSDSLKGFKDIITTKKFKKVFPTLSLGLDKEVRYAYRGGFTWLNDRFKEKEIGEGMVFDVNSLYPAQMYSRLLPYGEPIVFEGKYVWDEDYPLHIQHIRCEFELKEGYIPTIQIKRSRFYKGNEYLKSSGGEIADLWLSNVDLELMKEHYDLYNVEYISGLKFKATTGLFKDFIDKWTYIKTTSYGAIKQLAKLMLNSLYGKFASNPDVTGKVPYLKENGALGFRLGEEETKDPVYTPMGVFITAWARYTTITAAQACYDRIIYCDTDSIHLTGTEIPDVIKDIVDPKKLGYWEHESTFKRAKYLRQKTYIQDIYMKEVDGYLVEGSPDDYTDIKFSVKCAGMTDKIKKEVTFENFKVGFSRKMKPKPVQVPGGVVLVDDTFTIK

SEQ ID NO: 67 - protein, 616 aa, Artificial
  mutant recombinant phi29-type DNA polymerase
MSVDGLNDIFEAQKIEWHEAMGHHHHHHHHHHSSGHIEGRHMKHMPRKMYSCDFETTTKVEDCRVWAYGYMNIEDHSEYKIGNSLDEFMAWVLKVQADLYFHDLKFDGAFIINWLERNGFKWSADGLPNTYNTIISRMGQWYMIDICLGYKGKRKIHTVIYDSLKKLPFPVKKIAKDFKLTVLKGDIDYHKERPVGYKITPEEYAYIKNDIQIIAEALLIQFKQGLDRMTEGSDSLKGFKDIITTKKFKKVFPTLSLGLDKEVRYAYRGGFTWLNDRFKEKEIGEGMVFDVNSLYPAQMYSRLLPYGEPIVFEGKYVWDEDYPLHIQHIRCEFELKEGYIPTIQIKRSRFYKGNEYLKSSGGEIADLWLSNVDLELMKEHYDLYNVEYISGLKFKATTGLFKDFIDKWTYIKTTSYGAIKQLAKLMLNSLYGKFASNPDVTGKVPYLKENGALGFRLGEEETADPVYTPMGVFITAWARYTTITAAQACYDRIIYCDTDSIHLTGTEIPDVIKDIVDPKKLGYWEHESTFKRAKYLRQKTYIQDIYMKRVDGYLVEGSPDDYTDIKFSVKCAGMTDKIKKEVTFENFKVGFSRKMKPKPVQVPGGVVLVDDTFTIK

SEQ ID NO: 68 - protein, 631 aa, Artificial
  mutant recombinant phi29-type DNA polymerase
MSVDGLNDIFEAQKIEWHEAMGHHHHHHHHHHSSGHIEGRHMKHMPRKMYSCDFETTTKVEDCRVWAYGYMNIEDHSEYKIGNSLDEFMAWVLKVQADLYFHDLKFDGAFIINWLERNGFKWSADGLPNTYNTYISRMGQWYMIDICLGYKGKRKIHTVIYDSLKKLPFPVKKIAKDFKLTVLKGDIDYHKERPVGYKITPEEYAYIKNDIQIIAEALLIQFKQGLDRMTAGSDSLKGFKDIITTKKFKKVFPTLSLGLDKEVRYAYRGGFTWLNDRFKEKEIGEGMVFDVNSLYPAQMYSRLLPYGEPIVFEGKYVWDEDYPLHIQHIRCEFELKEGYIPTIQIKRSRFYKGNEYLKSSGGEIADLWLSNVDLELMKEHYDLYNVEYISGLKFKATTGLFKDFIDKWFYIKYTSYGAWKQLAKLMLNSLYGKFASNPDVTGKVPYLKENGALGFRLGEEETKDPVYTPMGVFITAWARYTTITAAQACYDRIIYCDTDSIHLTGTEIPDVIKDIVDPYKLGYWEHESTFKRAKYLRQKTYIQDIYMKRVDGKSYGSLVEGSPDDYTDIKFSVKCAGMTDKIKKEVTFENFKVGFSRKMKPKPVQVPGGVVLVDDTFTIKGHHHHHHHHHH

SEQ ID NO: 69 - protein, 616 aa, Artificial
  mutant recombinant phi29-type DNA polymerase
MSVDGLNDIFEAQKIEWHEAMGHHHHHHHHHHSSGHIEGRHMKHMPRKMYSCDFETTTKVEDCRVWAYGYMNIEDHSEYKIGNSLDEFMAWVLKVQADLYFHDLKFDGAFIINWLERNGFKWSADGLPNTYNTIISRMGQWYMIDICLGYKGKRKIHTVIYDSLKKLPFPVKKIAKDFKLTVLKGDIDYHKERPVGYKITPEEYAYIKNDIQIIAEALLIQFKQGLDRMTAGSDSLKGFKDIITTKKFKKVFPTLSLGLDKEVRYAYRGGFTWLNDRFKEKEIGEGMVFDVNSLYPAQMYSRLLPYGEPIVFEGKYVWDEDYPLHIQHIRCEFELKEGYIPTIQIKRSRFYKGNEYLKSSGGEIADLWLSNVDLELMKEHYDLYNVEYISGLKFKATTGLFKDFIDKWFYIKTTSYGAIKQLAKLMLNSLYGKFASNPDVTGKVPYLKENGALGFRLGEEETKDPVYTPMGVFITAWARYTTITAAQACYDRIIYCDTDSIHLTGTEIPDVIKDIVDQKKLGYWEHESTFKRAKYLRQKTYIQDIYMKEVDGYLVEGSPDDYTDIKFSVKCAGMTDKIKKEVTFENFKVGFSRKMKPKPVQVPGGVVLVDDTFTIK

SEQ ID NO: 70 - protein, 616 aa, Artificial
  mutant recombinant phi29-type DNA polymerase
MSVDGLNDIFEAQKIEWHEAMGHHHHHHHHHHSSGHIEGRHMKHMPRKMYSCDFETTTKVEDCRVWAYGYMNIEDHSEYKIGNSLDEFMAWVLKVQADLYFHDLKFDGAFIINWLERNGFKWSADGLPNTYNTIISRMGQWYMIDICLGYKGKRKIHTVIYDSLKKLPFPVKKIAKDFKLTVLKGDIDYHKERPVGYKITPEEYAYIKNDIQIIAEALLIQFKQGLDRMTAGSDSLKGFKDIITTKKFKKVFPTLSLGLDKEVRYAYRGGFTWLNDRFKEKEIGEGMVFDVNSLYPAQMYSRLLPYGEPIVFEGKYVWDEDYPLHIQHIRCEFELKEGYIPTIQIKRSRFYKGNEYLKSSGGEIADLWLSNVDLELMKEHYDLYNVEYISGLKFKATTGLFKDFIDKWFYIKTTSYGAIKQLAKMMLNSLYGKFASNPDVTGKVPYLKENGALGFRLGEEETKDPVYTPMGVFITAWARYTTITAAQACYDRIIYCDTDSIHLTGTEIPDVIKDIVDPKKLGYWEHESTFKRAKYLRQKTYIQDIYMKEVDGYLVEGSPDDYTDIKFSVKCAGMTDKIKKEVTFENFKVGFSRKMKPKPVQVPGGVVLVDDTFTIK

SEQ ID NO: 71 - protein, 616 aa, Artificial
  mutant recombinant phi29-type DNA polymerase
MSVDGLNDIFEAQKIEWHEAMGHHHHHHHHHHSSGHIEGRHMKHMPRKMYSCDFETTTKVEDCRVWAYGYMNIEDHSEYKIGNSLDEFMAWVLKVQADLYFHNLKFDGAFIINWLERNGFKWSADGLPNTYNTIISRMGQWYMIDICLGYKGKRKIHTVIYDSLKKLPFPVKKIAKDFKLTVLKGDIDYHKERPVGYKITPEEYAYIKNDIQIIAEALLIQFKQGLDRMTAGSDSLKGFKDIITTKKFKKVFPTLSLGLDKEVRYAYRGGFTWLNDRFKEKEIGEGMVFDVNSLYPAQMYSRLLPYGEPIVFEGKYVWDEDYPLHIQHIRCEFELKEGYIPTIQIKRSRFYKGNEYLKSSGGEIADLWLSNVDLELMKEHYDLYNVEYISGLKFKATTGLFKDFIDKWFYIKTTSYGAIKQLAKLMLNSLYGKFASNPDVTGKVPYLKENGALGFRLGEEETKDPVYTPMGVFITAWARYTTITAAQACYDRIIYCDTDSIHLTGTEIPDVIKDIVDEKKLGYWAHESTFKRAKYLRQKTYIQDIYMKEVDGYLVEGSPDDYTDIKFSVKCAGMTDKIKKEVTFENFKVGFSRKMKPKPVQVPGGVVLVDDTFTIK

SEQ ID NO: 72 - protein, 616 aa, Artificial
  mutant recombinant phi29-type DNA polymerase
MSVDGLNDIFEAQKIEWHEAMGHHHHHHHHHHSSGHIEGRHMKHMPRKMYSCDFETTTKVEDCRVWAYGYMNIEDHSEYKIGNSLDEFMAWVLKVQADLYFHNLKFDGAFIINWLERNGFKWSADGLPNTYNTIISRMGQWYMIDICLGYKGKRKIHTVIYDSLKKLPFPVKKIAKDFKLTVLKGDIDYHKERPVGYKITPEEYAYIKNDIQIIAEVLLIQFKQGLDRMTAGSDSLKGFKDIITTKKFKKVFPTLSLGLDKEVRYAYRGGFTWLNDRFKEKEIGEGMVFDVNSLYPAQMYSRLLPYGEPIVFEGKYVWDEDYPLHIQHIRCEFELKEGYIPTIQIKRSRFYKGNEYLKSSGGEIADLWLSNVDLELMKEHYDLYNVEYISGLKFKATTGLFKDFIDKWFYIKTTSYGAIKQLAKLMLNSLYGKFASNPDVTGKVPYLKENGALGFRLGEEETKDPVYTPMGVFITAWARYTTITAAQACYDRIIYCDTDSIHLTGTEIPDVIKDIVDPKKLGYWAHESTFKRAKYLRQKTYIQDIYMKEVDGYLVEGSPDDYTDIKFSVKCAGMTDKIKKEVTFENFKVGFSRKMKPKPVQVPGGVVLVDDTFTIK

SEQ ID NO: 73 - protein, 616 aa, Artificial
  mutant recombinant phi29-type DNA polymerase
MSVDGLNDIFEAQKIEWHEAMGHHHHHHHHHHSSGHIEGRHMKHMPRKMYSCDFETTTKVEDCRVWAYGYMNIEDHSEYKIGNSLDEFMAWVLKVQADLYFHNLKFDGAFIINWLERNGFKWSADGLPNTYNTIISRMGQWYMIDICLGYKGKRKIHTVIYDSLKKLPFPVKKIAKDFKLTVLKGDIDYHKERPVGYKITPEEYAYIKNDIQIIAEALLIQFKQGLDRMTAGSDSLKGFKDIITTKKFKKVFPTLSLGLDKEVRYAYRGGFTWLNDRFKEKEIGEGMVFDVNSLYPAQMYSRLLPYGEPIVFEGKYVWDEDYPLHIQHIRCEFELKEGYIPTIQIKRSRFYKGNEYLKSSGGEIADLWLSNVDLELMKEHYDLYNVEYISGLKFKATTGLFKDFIDKWFYIKTTSYGAIKQLAKLMLNSLYGKFASNPDVTGKVPYLKENGALGFRLGEEETRDPVYTPMGVFITAWARYTTITAAQACYDRIIYCDTDSIHLTGTEIPDVIKDIVDPKKLGYWAHESTFKRAKYLRQKTYIQDIYMKEVDGYLVEGSPDDYTDIKFSVKCAGMTDKIKKEVTFENFKVGFSRKMKPKPVQVPGGVVLVDDTFTIK

SEQ ID NO: 74 - protein, 616 aa, Artificial
  mutant recombinant phi29-type DNA polymerase
MSVDGLNDIFEAQKIEWHEAMGHHHHHHHHHHSSGHIEGRHMKHMPRKMYSCDFETTTKVEDCRVWAYGYMNIEDHSEYKIGNSLDEFMAWVLKVQADLYFHDLKFDGAFIINWLERNGFKWSADGLPNTYNTIISRMGQWYMIDICLGYKGKRKIHTVIYDSLKKLPFPVKKIAKDFKLTVLKGDIDYHKERPVGYKITPEEYAYIKNDIQIIAEALLIQFKQGLDRMTAGSDSLKGFKDIITTKKFKKVFPTLSLGLDKEVRYAYRGGFTWLNDRFKEKEIGEGMVFDVNSLYPAQMYSRLLPYGEPIVFEGKYVWDEDYPLHIQHIRCEFELKEGYIPTIQIKRSRFYKGNEYLKSSGGEIADLWLSNVDLELMKEHYDLYNVEYISGLKFKATTGLFKDFIDKWTYIKTTSYGAIKQLAKLMLNSLYGKFASNPDVTGKVPYLKENGALGFRLGEEETKDPVYTPMGVFITAWARYTTITAAQACYDRIIYCDTDSIHLTGTEIPDVIKDIVDQKKLGYWEHESTFKRAKYLRQKTYIQDIYMKEVDGYLVEGSPDDYTDIKFSVKCAGMTDKIKKEVTFENFKVGFSRKMKPKPVQVPGGVVLVDDTFTIK

SEQ ID NO: 75 - protein, 616 aa, Artificial
  mutant recombinant phi29-type DNA polymerase
MSVDGLNDIFEAQKIEWHEAMGHHHHHHHHHHSSGHIEGRHMKHMPRKMYSCDFETTTKVEDCRVWAYGYMNIEDHSEYKIGNSLDEFMAWVLKVQADLYFHNLKFDGAFIINWLERNGFKWSADGLPNTYNTFISRMGQWYMIDICLGYKGKRKIHTVIYDSLKKLPFPVKKIAKDFKLTVLKGDIDYHKERPVGYKITPEEYAYIKNDIQIIAEALLIQFKQGLDRMTAGSDSLKGFKDIITTKKFKKVFPTLSLGLDKEVRYAYRGGFTWLNDRFKEKEIGEGMVFDVNSLYPAQMYSRLLPYGEPIVFEGKYVWDEDYPLHIQHIRCEFELKEGYIPTIQIKRSRFYKGNEYLKSSGGEIADLWLSNVDLELMKEHYDLYNVEYISGLKFKATTGLFKDFIDKWFYIKTTSYGAIKQLAKLMLNSLYGKFASNPDVTGKVPYLKENGALGFRLGEEETKDPVYTPMGVFITAWARYTTITAAQACYDRIIYCDTDSIHLTGTEIPDVIKDIVDPKKLGYWEHESTFKRAKYLRQKTYIQDIYMKEVDGYLVEGSPDDYTDIKFSVKCAGMTDKIKKEVTFENFKVGFSRKMKPKPVQVPGGVVLVDDTFTIK

SEQ ID NO: 76 - protein, 616 aa, Artificial
  mutant recombinant phi29-type DNA polymerase
MSVDGLNDIFEAQKIEWHEAMGHHHHHHHHHHSSGHIEGRHMKHMPRKMYSCDFETTTKVEDCRVWAYGYMNIEDHSEYKIGNSLDEFMAWVLKVQADLYFHNLKFDGAFIINWLERNGFKWSADGLPNTYNTIISRMGQWYMIDICLGYKGKRKIHTVIYDSLKKLPFPVKKIAKDFKLTVLKGDIDYHKERPVGYKITPEEYAYIKNDIQIIAEALLIQFKQGLDRMTAGSDSLKGFKDIITTKKFKKVFPTLSLGLDKEVRYAYRGGFTWLNDRFKEKEIGEGMVFDVNSAYPAQMYSRLLPYGEPIVFEGKYVWDEDYPLHIQHIRCEFELKEGYIPTIQIKRSRFYKGNEYLKSSGGEIADLWLSNVDLELMKEHYDLYNVEYISGLKFKATTGLFKDFIDKWTYIKTTSYGAIKQLAKLMLNSLYGKFASNPDVTGKVPYLKENGALGFRLGEEETKDPVYTPMGVFITAWARYTTITAAQACYDRIIYCDTDSIHLTGTEIPDVIKDIVDPKKLGYWEHESTFKRAKYLRQKTYIQDIYMKEVDGYLVEGSPDDYTDIKFSVKCAGMTDKIKKEVTFENFKVGFSRKMKPKPVQVPGGVVLVDDTFTIK

SEQ ID NO: 77 - protein, 616 aa, Artificial
  mutant recombinant phi29-type DNA polymerase
MSVDGLNDIFEAQKIEWHEAMGHHHHHHHHHHSSGHIEGRHMKHMPRKMYSCDFETTTKVEDCRVWAYGYMNIEDHSEYKIGNSLDEFMAWVLKVQADLYFHDLKFDGAFIINWLERNGFKWSADGLPNTYNTIISRMGQWYMIDICLGYKGKRKIHTVIYDSLKKLPFPVKKIAKDFKLTVLKGDIDYHKERPVGYKITPEEYAYIKNDIQIIAEALLIQFKQGLDRMTAGSDSLKGFKDIITTKKFKKVFPTLSLGLDKEVRYAYRGGFTWLNDRFKEKEIGEGMVFDVNSAYPAQMYSRLLPYGEPIVFEGKYVWDEDYPLHIQHIRCEFELKEGYIPTIQIKRSRFYKGNEYLKSSGGEIADLWLSNVDLELMKEHYDLYNVEYISGLKFKATTGLFKDFIDKWTYIKTTSYGAIKQLAKLMLNSLYGKFASNPDVTGKVPYLKENGALGFRLGEEMTKDPVYTPMGVFITAWARYTTITAAQACYDRIIYCDTDSIHLTGTEIPDVIKDIVDPKKLGYWEHESTFKRAKYLRQKTYIQDIYMKEVDGYLVEGSPDDYTDIKFSVKCAGMTDKIKKEVTFENFKVGFSRKMKPKPVQVPGGVVLVDDTFTIK

SEQ ID NO: 78 - protein, 616 aa, Artificial
  mutant recombinant phi29-type DNA polymerase
MSVDGLNDIFEAQKIEWHEAMGHHHHHHHHHHSSGHIEGRHMKHMPRKMYSCDFETTTKVEDCRVWAYGYMNIEDHSEYKIGNSLDEFMAWVLKVQADLYFHDLKFDGAFIINWLERNGFKWSADGLPNTYNTIISRMGQWYMIDICLGYKGKRKIHTVIYDSLKKLPFPVKKIAKDFKLTVLKGDIDYHKERPVGYKITPEEYAYIKNDIQIIAEALLIQFKQGLDRMTAGSDSLKGFKDIITTKKFKKVFPTLSLGLDKEVRYAYRGGFTWLNDRFKEKEIGEGMVFDVNSAYPAQMYSRLLPYGEPIVFEGKYVWDEDYPLHIQHIRCEFELKEGYIPTIQIKRSRFYKGNEYLKSSGGEIADLWLSNVDLELMKEHYDLYNVEYISGLKFKATTGLFKDFIDKWTYIKTTSYGAIKQLAKLMLNSLYGKFASNPDVTGKVPYLKENGALGFRLGEEETADPVYTPMGVFITAWARYTTITAAQACYDRIIYCDTDSIHLTGTEIPDVIKDIVDPKKLGYWEHESTFKRAKYLRQKTYIQDIYMKEVDGYLVEGSPDDYTDIKFSVKCAGMTDKIKKEVTFENFKVGFSRKMKPKPVQVPGGVVLVDDTFTIK

SEQ ID NO: 79 - protein, 616 aa, Artificial
  mutant recombinant phi29-type DNA polymerase
MSVDGLNDIFEAQKIEWHEAMGHHHHHHHHHHSSGHIEGRHMKHMPRKMYSCDFETTTKVEDCRVWAYGYMNIEDHSEYKIGNSLDEFMAWVLKVQADLYFHDLKFDGAFIINWLERNGFKWSADGLPNTYNTIISRMGQWYMIDICLGYKGKRKIHTVIYDSLKKLPFPVKKIAKDFKLTVLKGDIDYHKERPVGYKITPEEYAYIKNDIQIIAEALLIQFKQGLDRMTAGSDSLKGFKDIITTKKFKKVFPTLSLGLDKEVRYAYRGGFTWLNDRFKEKEIGEGMVFDVNSAYPAQMYSRLLPYGEPIVFEGKYVWDEDYPLHIQHIRCEFELKEGYIPTIQIKRSRFYKGNEYLKSSGGEIADLWLSNVDLELMKEHYDLYNVEYISGLKFKATTGLFKDFIDKWTYIKTTSYGAIKQLAKLMLNSLYGKFASNPDVTGKVPYLKENGALGFRLGEEETKDPVYTPMGVFITAWARYTTITAAQACYDRIIYCDTDSIHLTGTEIPDVIKDIVDPKKLGYWEHESTFKRAKYLRQKTYIQDIYMKKVDGYLVEGSPDDYTDIKFSVKCAGMTDKIKKEVTFENFKVGFSRKMKPKPVQVPGGVVLVDDTFTIK

SEQ ID NO: 80 - protein, 616 aa, Artificial
  mutant recombinant phi29-type DNA polymerase
MSVDGLNDIFEAQKIEWHEAMGHHHHHHHHHHSSGHIEGRHMKHMPRKMYSCDFETTTKVEDCRVWAYGYMNIEDHSEYKIGNSLDEFMAWVLKVQADLYFHDLKFDGAFIINWLERNGFKWSADGLPNTYNTIISRMGQWYMIDICLGYKGKRKIHTVIYDSLKKLPFPVKKIAKDFKLTVLKGDIDYHKERPVGYKITPEEYAYIKNDIQIIAEALLIQFKQGLDRMTAGSDSLKGFKDIITTKKFKKVFPTLDLGLDKEVRYAYRGGFTWLNDRFKEKEIGEGMVFDVNSAYPAQMYSRLLPYGEPIVFEGKYVWDEDYPLHIQHIRCEFELKEGYIPTIQIKRSRFYKGNEYLKSSGGEIADLWLSNVDLELMKEHYDLYNVEYISGLKFKATTGLFKDFIDKWTYIKTTSYGAIKQLAKLMLNSLYGKFASNPDVTGKVPYLKENGALGFRLGEEETKDPVYTPMGVFITAWARYTTITAAQACYDRIIYCDTDSIHLTGTEIPDVIKDIVDPKKLGYWEHESTFKRAKYLRQKTYIQDIYMKEVDGYLVEGSPDDYTDIKFSVKCAGMTDKIKKEVTFENFKVGFSRKMKPKPVQVPGGVVLVDDTFTIK

SEQ ID NO: 81 - protein, 616 aa, Artificial
  mutant recombinant phi29-type DNA polymerase
MSVDGLNDIFEAQKIEWHEAMGHHHHHHHHHHSSGHIEGRHMKHMPRKMYSCDFETTTKVEDCRVWAYGYMNIEDHSEYKIGNSLDEFMAWVLKVQADLYFHDLKFDGAFIINWLERNGFKWSADGLPNTYNTIISRMGQWYMIDICLGYKGKRKIHTVIYDSLKKLPFPVKKIAKDFKLTVLKGDIDYHKERPVGYKITPEEYAYIKNDIQIIAEALLIQFKQGLDRMTAGSDSLKGFKDIITTKKFKKVFPTLSLGLDKEVRYAYRGGFTWLNDRFKEKEIGEGMVFDVNSTYPAQMYSRLLPYGEPIVFEGKYVWDEDYPLHIQHIRCEFELKEGYIPTIQIKRSRFYKGNEYLKSSGGEIADLWLSNVDLELMKEHYDLYNVEYISGLKFKATTGLFKDFIDKWTYIKTTSYGAIKQLAKLMLNSLYGKFASNPDVTGKVPYLKENGALGFRLGEEETKDPVYTPMGVFITAWARYTTITAAQACYDRIIYCDTDSIHLTGTEIPDVIKDIVDPKKLGYWEHESTFKRAKYLRQKTYIQDIYMKEVDGYLVEGSPDDYTDIKFSVKCAGMTDKIKKEVTFENFKVGFSRKMKPKPVQVPGGVVLVDDTFTIK

SEQ ID NO: 82 - protein, 616 aa, Artificial
  mutant recombinant phi29-type DNA polymerase
MSVDGLNDIFEAQKIEWHEAMGHHHHHHHHHHSSGHIEGRHMKHMPRKMYSCDFETTTKVEDCRVWAYGYMNIEDHSEYKIGNSLDEFMAWVLKVQADLYFHDLKFDGAFIINWLERNGFKWSADGLPNTYNTIISRMGQWYMIDICLGYKGKRKIHTVIYDSLKKLPFPVKKIAKDFKLTVLKGDIDYHKERPVGYKITPEEYAYIKNDIQIIAEALLIQFKQGLDRMTAGSDSLKGFKDIITTKKFKKVFPTLSLGLDKEVRYAYRGGFTWLNDRFKEKEIGEGMVFDVNSAYPAQMYSRLLPYGEPIVFEGKYVWDEDYPLHIQHIRCEFELKEGYIPTIQIKRSRFYKGNEYLKSSGGEIADLWLSNVDLELMKEHYDLYNVEYISGLKFKATTGLFKDFIDKWTHIKTTSYGAIKQLAKLMLNSLYGKFASNPDVTGKVPYLKENGALGFRLGEEETKDPVYTPMGVFITAWARYTTITAAQACYDRIIYCDTDSIHLTGTEIPDVIKDIVDPKKLGYWEHESTFKRAKYLRQKTYIQDIYMKEVDGYLVEGSPDDYTDIKFSVKCAGMTDKIKKEVTFENFKVGFSRKMKPKPVQVPGGVVLVDDTFTIK

SEQ ID NO: 83 - protein, 616 aa, Artificial
  mutant recombinant phi29-type DNA polymerase
MSVDGLNDIFEAQKIEWHEAMGHHHHHHHHHHSSGHIEGRHMKHMPRKMYSCDFETTTKVEDCRVWAYGYMNIEDHSEYKIGNSLDEFMAWVLKVQADLYFHDLKFDGAFIINWLERNGFKWSADGLPNTYNTIISRMGQWYMIDICLGYKGKRKIHTVIYDSLKKLPFPVKKIAKDFKLTVLKGDIDYHKERPVGYKITPEEYAYIKNDIQIIAEALLIQFKQGLDRMTAGSDSLKGFKDIITTKKFKKVFPTLSLGLDKEVRYAYRGGFTWLNDRFKEKEIGEGMVFDVNSAYPAQMYSRLLPYGEPIVFEGKYVWDEDYPLHIQHIRCEFELKEGYIPTIQIKRSRFYKGNEYLKSSGGEIADLWLSNVDLELMKEHYDLYNVEYISGLKFKATTGLFKDFIDKWTGIKTTSYGAIKQLAKLMLNSLYGKFASNPDVTGKVPYLKENGALGFRLGEEETKDPVYTPMGVFITAWARYTTITAAQACYDRIIYCDTDSIHLTGTEIPDVIKDIVDPKKLGYWEHESTFKRAKYLRQKTYIQDIYMKEVDGYLVEGSPDDYTDIKFSVKCAGMTDKIKKEVTFENFKVGFSRKMKPKPVQVPGGVVLVDDTFTIK

SEQ ID NO: 84 - protein, 616 aa, Artificial
  mutant recombinant phi29-type DNA polymerase
MSVDGLNDIFEAQKIEWHEAMGHHHHHHHHHHSSGHIEGRHMKHMPRKMYSCDFETTTKVEDCRVWAYGYMNIEDHSEYKIGNSLDEFMAWVLKVQADLYFHDLKFDGAFIINWLERNGFKWSADGLPNTYNTIISRMGQWYMIDICLGYKGKRKIHTVIYDSLKKLPFPVKKIAKDFKLTVLKGDIDYHKERPVGYKITPEEYAYIKNDIQIIAEALLIQFKQGLDRMTAGSDSLKGFKDIITTKKFKKVFPTLSLGLDKEVRYAYRGGFTWLNDRFKEKEIGEGMVFDVNSAYPAQMYSRLLPYGEPIVFEGKYVWDEDYPLHIQHIRCEFELKEGYIPTIQIKRSRFYKGNEYLKSSGGEIADLWLSNVDLELMKEHYDLYNVEYISGLKFKATTGLFKDFIDKWTLIKTTSYGAIKQLAKLMLNSLYGKFASNPDVTGKVPYLKENGALGFRLGEEETKDPVYTPMGVFITAWARYTTITAAQACYDRIIYCDTDSIHLTGTEIPDVIKDIVDPKKLGYWEHESTFKRAKYLRQKTYIQDIYMKEVDGYLVEGSPDDYTDIKFSVKCAGMTDKIKKEVTFENFKVGFSRKMKPKPVQVPGGVVLVDDTFTIK

SEQ ID NO: 85 - protein, 616 aa, Artificial
  mutant recombinant phi29-type DNA polymerase
MSVDGLNDIFEAQKIEWHEAMGHHHHHHHHHHSSGHIEGRHMKHMPRKMYSCDFETTTKVEDCRVWAYGYMNIEDHSEYKIGNSLDEFMAWVLKVQADLYFHDLKFDGAFIINWLERNGFKWSADGLPNTYNTIISRMGQWYMIDICLGYKGKRKIHTVIYDSLKKLPFPVKKIAKDFKLTVLKGDIDYHKERPVGYKITPEEYAYIKNDIQIIAEALLIQFKQGLDRMTAGSDSLKGFKDIITTKKFKKVFPTLSLGLDKEVRYAYRGGFTWLNDRFKEKEIGEGMVFDVNSAYPAQMYSRLLPYGEPIVFEGKYVWDEDYPLHIQHIRCEFELKEGYIPTIQIKRSRFYKGNEYLKSSGGEIADLWLSNVDLELMKEHYDLYNVEYISGLKFKATTGLFKDFIDKWTYIKTTSFGAIKQLAKLMLNSLYGKFASNPDVTGKVPYLKENGALGFRLGEEETKDPVYTPMGVFITAWARYTTITAAQACYDRIIYCDTDSIHLTGTEIPDVIKDIVDPKKLGYWEHESTFKRAKYLRQKTYIQDIYMKEVDGYLVEGSPDDYTDIKFSVKCAGMTDKIKKEVTFENFKVGFSRKMKPKPVQVPGGVVLVDDTFTIK

SEQ ID NO: 86 - protein, 616 aa, Artificial
  mutant recombinant phi29-type DNA polymerase
MSVDGLNDIFEAQKIEWHEAMGHHHHHHHHHHSSGHIEGRHMKHMPRKMYSCDFETTTKVEDCRVWAYGYMNIEDHSEYKIGNSLDEFMAWVLKVQADLYFHNLKFRGAFIINWLERNGFKWSADGLPNTYNTIISRMGQWYMIDICLGYKGKRKIHTVIYDSLKKLPFPVKKIAKDFKLTVLKGDIDYHKERPVGYKITPEEYAYIKNDIQIIAEALLIQFKQGLDRMTAGSDSLKGFKDIITTKKFKKVFPTLSLGLDKEVRYAYRGGFTWLNDRFKEKEIGEGMVFDVNSAYPAQMYSRLLPYGEPIVFEGKYVWDEDYPLHIQHIRCEFELKEGYIPTIQIKRSRFYKGNEYLKSSGGEIADLWLSNVDLELMKEHYDLYNVEYISGLKFKATTGLFKDFIDKWTYIKTTSYGAIKQLAKLMLNSLYGKFASNPDVTGKVPYLKENGALGFRLGEEETKDPVYTPMGVFITAWARYTTITAAQACYDRIIYCDTDSIHLTGTEIPDVIKDIVDPKKLGYWEHESTFKRAKYLRQKTYIQDIYMKEVDGYLVEGSPDDYTDIKFSVKCAGMTDKIKKEVTFENFKVGFSRKMKPKPVQVPGGVVLVDDTFTIK

SEQ ID NO: 87 - protein, 616 aa, Artificial
  mutant recombinant phi29-type DNA polymerase
MSVDGLNDIFEAQKIEWHEAMGHHHHHHHHHHSSGHIEGRHMKHMPRKMYSCDFETTTKVEDCRVWAYGYMNIEDHSEYKIGNSLDEFMAWVLKVQADLYFHDLKFDGAFIINWLERNGFKWSADGLPNTYNTIISRMGQWYMIDICLGYKGKRKIHTVIYDSLKKLPFPVKKIAKDFKLTVLKGDIDYHKERPVGYKITPEEYAYIKNDIQIIAEALLIQFKQGLDRMTAGSDSLKGFKDIITTKKFKKVFPTLSLGLDKEVRYAYRGGFTWLNDRFKEKEIGEGMVFDVNSAYPAQMYSRLLPYGEPIVFEGKYVWDEDYPLHIQHIRCEFELKEGYIPTIQIKRSRFYKGNEYLKSSGGEIADLWLSNVDLELMKEHYDLYNVEYISGLKFKATTGLFKDFIDKWTYIKTTSYGAIKQLAKLMLNSLYGKFASNPDVTGKVPYLKENGALGFRLGEEETKDPVYTPMGVFITAWARYTTITAAQACYDRIIYCDTDSIHLTGTEIPDVIKDIVDPKKLGYWEHESTFKRAKYLRQKTYIQDRYMKEVDGYLVEGSPDDYTDIKFSVKCAGMTDKIKKEVTFENFKVGFSRKMKPKPVQVPGGVVLVDDTFTIK

SEQ ID NO: 88 - protein, 616 aa, Artificial
  mutant recombinant phi29-type DNA polymerase
MSVDGLNDIFEAQKIEWHEAMGHHHHHHHHHHSSGHIEGRHMKHMPRKMYSCDFETTTKVEDCRVWAYGYMNIEDHSEYKIGNSLDEFMAWVLKVQADLYFHDLKFDGAFIINWLERNGFKWSADGLPNTYNTIISRMGQWYMIDICLGYKGKRKIHTVIYDSLKKLPFPVKKIAKDFKLTVLKGDIDYHKERPVGYKITPEEYAYIKNDIQIIAEALLIQFKQGLDRMTAGSDSLKGFKDIITTKKFKKVFPTLSLGLDKEVRYAYRGGFTWLNDRFKEKEIGEGMVFDVNSAYPAQMYSRLLPYGEPIVFEGKYVWDEDYPLHIQHIRCEFELKEGYIPTIQIKRSRFYKGNEYLKSSGGEIADLWLSNVDLELMKEHYDLYNVEYISGLKFKATTGLFKDFIDKWTYIKTTSYGAIKQLAKLMLNSLYGKFASNPDVTGKVPYLKENGALGFRLGEEETKDPVYTPMGVFITAWARYTTITAAQACYDRIIYCDTDSIHLTGTEIPDVIKDIVDPKKLGYWEHESTFKRAKYLRQKTYIQDIYMKEVKGYLVEGSPDDYTDIKFSVKCAGMTDKIKKEVTFENFKVGFSRKMKPKPVQVPGGVVLVDDTFTIK

SEQ ID NO: 89 - protein, 627 aa, Artificial
  mutant recombinant phi29-type DNA polymerase
MSVDGLNDIFEAQKIEWHEAMGHHHHHHHHHHSSGHIEGRHMKHMPRKMYSCDFETTTKVEDCRVWAYGYMNIEDHSEYKIGNSLDEFMAWVLKVQADLYFHNLKFDGAFIINWLERNGFKWSADGLPNTYNTIISRMGQWYMIDICLGYKGKRKIHTVIYDSLKKLPFPVKKIAKDFKLTVLKGDIDYHKERPVGYKITPEEYAYIKNDIQIIAEALLIQFKQGLDRMTAGSDSLKGFKDIITTKKFKKVFPTLSLGLDKEVRYAYRGGFTWLNDRFKEKEIGEGMVFDVNSAYPAQMYSRLLPYGEPIVFEGKYVWDEDYPLHIQHIRCEFELKEGYIPTIQIKRSRFYKGNEYLKSSGGEIADLWLSNVDLELMKEHYDLYNVEYISGLKFKATTGLFKDFIDKWTYIKTTSYGAIKQLAKLMLNSLYGKFASNPDVTGKVPYLKENGALGFRLGEEETKDPVYTPMGVFITAWARYTTITAAQACYDRIIYCDTDSIHLTGTEIPDVIKDIVDPKKLGYWEHESTFKRAKYLRQKTYIQDIYMKEVDGYLVEGSPDDYTDIKFSVKCAGMTDKIKKEVTFENFKVGFSRKMKPKPVQVPGGVVLVDDTFTIKGHHHHHHHHHH

SEQ ID NO: 90 - protein, 627 aa, Artificial
  mutant recombinant phi29-type DNA polymerase
MSVDGLNDFFEAQKIEWHEAMGHHHHHHHHHHSSGHIEGRHMKHMPRKMYSCDFETTTKVEDCRVWAYGYMNIEDHSEYKIGNSLDEFMAWVLKVQADLYFHNLKFDGAFIINWLERNGFKWSADGLPNTYNTIISRMGQWYMIDICLGYKGKRKIHTVIYDSLKKLPFPVKKIAKDFKLTVLKGDIDYHKERPVGYKITPEEYAYIKNDIQIIAEALLIQFKQGLDRMTAGSDSLKGFKDIITTKKFKKVFPTLSLGLDKEVRYAYRGGFTWLNDRFKEKEIGEGMVFDVNSAYPAQMYSRLLPYGEPIVFEGKYVWDEDYPLHIQHIRCEFELKEGYIPTIQIKRSRFYKGNEYLKSSGGEIADLWLSNVDLELMKEHYDLYNVEYISGLKFKATTGLFKDFIDKWTYIKTTSYGAIKQLAKLMLNSLYGKFASNPDVTGKVPYLKENGALGFRLGEEETKDPVYTPMGVFITAWARYTTITAAQACYDRIIYCDTDSIHLTGTEIPDVIKDIVDPKKLGYWEHESTFKRAKYLRQKTYIQDIYMKEVDGYLVEGSPDDYTDIKFSVKCAGMTDKIKKEVTFENFKVGFSRKMKPKPVQVPGGVVLVDDTFTIKGHHHHHHHHHH

SEQ ID NO: 91 - protein, 627 aa, Artificial
  mutant recombinant phi29-type DNA polymerase
MSVDGLNDIFEAQKIEWHEAMGHHHHHHHHHHSSGHIEGRHMKHMPRKMYSCDFETTTKVEDCRVWAYGYMNIEDHSEYKIGNSLDEFMAWVLKVQADLYFHNLKFDGAFIINWLERNGFKWSADGLPNTYNTIISRMGQWYMIDICLGYKGKRKIHTVIYDSLKKLPFPVKKIAKDFKLTVLKGDIDYHKERPVGYKITPEEYAYIKNDIQIIAEALLIQFKQGLDRMTAGSDSLKGFKDIITTKKFKKVFPTLSLGLDKEVRYAYRGGFTWLNDRFKEKEIGEGMVFDVNSAYPAQMYSRLLPYGEPIVFEGKYVWDEDYPLHIQHIRCEFELKEGYIPTIQIKRSRFYKGNEYLKSSGGEIADLWLSNVDLELMKEHYDLYNVEYISGLKFKATTGLFKDFIDKWTYIKTTSYGAIKQLAKLMLNSLYGKFASNPDVTGKVPYLKENGALGFRLGEEETKDPVYTPMGVFITAWARYTTITAAQACYDRIIYCDTDSIHLTGTEIPDVIKDIVDPKKLGYWEHESTFKRAKYLRQKTYIQDIYMKRVDGYLVEGSPDDYTDIKFSVKCAGMTDKIKKEVTFENFKVGFSRKMKPKPVQVPGGVVLVDDTFTIKGHHHHHHHHHH

SEQ ID NO: 92 - protein, 575 aa, Artificial
  mutant recombinant phi29-type DNA polymerase
MKHMPRKMYSCDFETTTKVEDCRVWAYGYMNIEDHSEYKIGNSLDEFMAWVLKVQADLYFHDLKFDGAFIINWLERNGFKWSADGLPNTYNTIISRMGQWYMIDICLGYKGKRKIHTVIYDSLKKLPFPVKKIAKDFKLTVLKGDIDYHKERPVGYKITPEEYAYIKNDIQIIAEALLIQFKQGLDRMTAGSDSLKGFKDIITTKKFKKVFPTLSLGLDKEVRYAYRGGFTWLNDRFKEKEIGEGMVFDVNSLYPAQMYSRLLPYGEPIVFEGKYVWDEDYPLHIQHIRCEFELKEGYIPTIQIKRSRFYKGNEYLKSSGGEIADLWLSNVDLELMKEHYDLYNVEYISGLKFKATTGLFKDFIDKWTYIKTTSYGAIKQLAKLMLNSLYGKFASNPDVTGKVPYLKENGALGFRLGEEETKDPVYTPMGVFITAWARYTTITAAQACYDRIIYCDTDSIHLTGTEIPDVIKDIVDPKKLGYWAHESTFKRAKYLRQKTYIQDIYMKEVDGYLVEGSPDDYTDIKFSVKCAGMTDKIKKEVTFENFKVGFSRKMKPKPVQVPGGVVLVDDTFTIK

SEQ ID NO: 93 - protein, 575 aa, Artificial
  mutant recombinant phi29-type DNA polymerase
MKHMPRKMYSCDFETTTKVEDCRVWAYGYMNIEDHSEYKIGNSLDEFMAWVLKVQADLYFHDLKFDGAFIINWLERNGFKWSADGLPNTYNTIISRMGQWYMIDICLGYKGKRKIHTVIYDSLKKLPFPVKKIAKDFKLTVLKGDIDYHKERPVGYKITPEEYAYIKNDIQIIAEALLIQFKQGLDRMTAGSDSLKGFKDIITTKKFKKVFPTLSLGLDKEVRYAYRGGFTWLNDRFKEKEIGEGMVFDVNSLYPAQMYSRLLPYGEPIVFEGKYVWDEDYPLHIQHIRCEFELKEGYIPTIQIKRSRFYKGNEYLKSSGGEIADLWLSNVDLELMKEHYDLYNVEYISGLKFKATTGLFKDFIDKWFYIKTTSYGAIKQLAKLMLNSLYGKFASNPDVTGKVPYLKENGALGFRLGEEETKDPVYTPMGVFITAWARYTTITAAQACYDRIIYCDTDSIHLTGTEIPDVIKDIVDPKKLGYWAHESTFKRAKYLRQKTYIQDIYMKEVDGYLVEGSPDDYTDIKFSVKCAGMTDKIKKEVTFENFKVGFSRKMKPKPVQVPGGVVLVDDTFTIK

SEQ ID NO: 94 - protein, 575 aa, Artificial; identical to SEQ ID NO: 93
  mutant recombinant phi29-type DNA polymerase

SEQ ID NO: 95 - protein, 575 aa, Artificial
  mutant recombinant phi29-type DNA polymerase
MKHMPRKMYSCDFETTTKVEDCRVWAYGYMNIEDHSEYKIGNSLDEFMAWVLKVQADLYFHNLKFDGAFIINWLERNGFKWSADGLPNTYNTIISRMGQWYMIDICLGYKGKRKIHTVIYDSLKKLPFPVKKIAKDFKLTVLKGDIDYHKERPVGYKITPEEYAYIKNDIQIIAEALLIQFKQGLDRMTAGSDSLKGFKDIITTKKFKKVFPTLSLGLDKEVRYAYRGGFTWLNDRFKEKEIGEGMVFDVNSLYPAQMYSRLLPYGEPIVFEGKYVWDEDYPLHIQHIRCEFELKEGYIPTIQIKRSRFYKGNEYLKSSGGEIADLWLSNVDLELMKEHYDLYNVEYISGLKFKATTGLFKDFIDKWFYIKTTSYGAIKQLAKLMLNSLYGKFASNPDVTGKVPYLKENGALGFRLGEEETKDPVYTPMGVFITAWARYTTITAAQACYDRIIYCDTDSIHLTGTEIPDVIKDIVDPKKLGYWAHESTFKRAKYLRQKTYIQDIYMKEVDGYLVEGSPDDYTDIKFSVKCAGMTDKIKKEVTFENFKVGFSRKMKPKPVQVPGGVVLVDDTFTIK

SEQ ID NO: 96 - protein, 575 aa, Artificial
  mutant recombinant phi29-type DNA polymerase
MKHMPRKMYSCDFETTTKVEDCRVWAYGYMNIEDHSEYKIGNSLDEFMAWVLKVQADLYFHDLKFDGAFIINWLERNGFKWSADGLPNTYNTIISRMGQWYMIDICLGYKGKRKIHTVIYDSLKKLPFPVKKIAKDFKLTVLKGDIDYHKERPVGYKITPEEYAYIKNDIQIIAEALLIQFKQGLDRMTAGSDSLKGFKDIITTKKFKKVFPTLSLGLDKEVRYAYRGGFTWLNDRFKEKEIGEGMVFDVNSAYPAQMYSRLLPYGEPIVFEGKYVWDEDYPLHIQHIRCEFELKEGYIPTIQIKRSRFYKGNEYLKSSGGEIADLWLSNVDLELMKEHYDLYNVEYISGLKFKATTGLFKDFIDKWTYIKTTSYGAIKQLAKLMLNSLYGKFASNPDVTGKVPYLKENGALGFRLGEEETKDPVYTPMGVFITAWARYTTITAAQACYDRIIYCDTDSIHLTGTEIPDVIKDIVDPKKLGYWEHESTFKRAKYLRQKTYIQDIYMKEVDGYLVEGSPDDYTDIKFSVKCAGMTDKIKKEVTFENFKVGFSRKMKPKPVQVPGGVVLVDDTFTIK

SEQ ID NO: 97 - protein, 575 aa, Artificial
  mutant recombinant phi29-type DNA polymerase
MKHMPRKMYSCDFETTTKVEDCRVWAYGYMNIEDHSEYKIGNSLDEFMAWVLKVQADLYFHDLKFDGAFIINWLERNGFKWSADGLPNTYNTIISRMGQWYMIDICLGYKGKRKIHTVIYDSLKKLPFPVKKIAKDFKLTVLKGDIDYHKERPVGYKITPEEYAYIKNDIQIIAEALLIQFKQGLDRMTAGSDSLKGFKDIITTKKFKKVFPTLSLGLDKEVRYAYRGGFTWLNDRFKEKEIGEGMVFDVNSAYPAQMYSRLLPYGEPIVFEGKYVWDEDYPLHIQHIRCEFELKEGYIPTIQIKRSRFYKGNEYLKSSGGEIADLWLSNVDLELMKEHYDLYNVEYISGLKFKATTGLFKDFIDKWTYIKTTSYGAIKQLAKLMLNSLYGKFASNPDVTGKVPYLKENGALGFRLGEEETKDPVYTPMGVFITAWARYTTITAAQACYDRIIYCDTDSIHLTGTEIPDVIKDIVDPKKLGYWAHESTFKRAKYLRQKTYIQDIYMKEVDGYLVEGSPDDYTDIKFSVKCAGMTDKIKKEVTFENFKVGFSRKMKPKPVQVPGGVVLVDDTFTIK

SEQ ID NO: 98 - protein, 575 aa, Artificial
  mutant recombinant phi29-type DNA polymerase
MKHMPRKMYSCDFETTTKVEDCRVWAYGYMNIEDHSEYKIGNSLDEFMAWVLKVQADLYFHDLKFDGAFIINWLERNGFKWSADGLPNTYNTIISRMGQWYMIDICLGYKGKRKIHTVIYDSLKKLPFPVKKIAKDFKLTVLKGDIDYHKERPVGYKITPEEYAYIKNDIQIIAEALLIQFKQGLDRMTAGSDSLKGFKDIITTKKFKKVFPTLSLGLDKEVRYAYRGGFTWLNDRFKEKEIGEGMVFDVNSLYPAQMYSRLLPYGEPIVFEGKYVWDEDYPLHIQHIRCEFELKEGYIPTIQIKRSRFYKGNEYLKSSGGEIADLWLSNVDLELMKEHYDLYNVEYISGLKFKATTGLFKDFIDKWFYIKTTSYGAIKQLAKLMLNSLYGKFASNPDVTGKVPYLKENGALGFRLGEEETKDPVYTPMGVFITAWARYTTITAAQACYDRIIYCDTDSIHLTGTEIPDVIKDIVDPKKLGYWEHESTFKRAKYLRQKTYIQDIYMKEVDGYLVEGSPDDYTDIKFSVKCAGMTDKIKKEVTFENFKVGFSRKMKPKPVQVPGGVVLVDDTFTIK

SEQ ID NO: 99 - protein, 575 aa, Artificial; identical to SEQ ID NO: 98
  mutant recombinant phi29-type DNA polymerase

SEQ ID NO: 100 - protein, 575 aa, Artificial; identical to SEQ ID NO: 96
  mutant recombinant phi29-type DNA polymerase

SEQ ID NO: 101 - protein, 575 aa, Artificial; identical to SEQ ID NO: 96
  mutant recombinant phi29-type DNA polymerase

SEQ ID NO: 102 - protein, 575 aa, Artificial
  mutant recombinant phi29-type DNA polymerase
MKHMPRKMYSCDFETTTKVEDCRVWAYGYMNIEDHSEYKIGNSLDEFMAWVLKVQADLYFHDLKFDGAFIINWLERNGFKWSADGLPNTYNTIISRMGQWYMIDICLGYKGKRKIHTVIYDSLKKLPFPVKKIAKDFKLTVLKGDIDYMKERPVGYKITPEEYAYIKNDIQIIAEALLIQFKQGLDRMTAGSDSLKGFKDIITTKKFKKVFPTLSLGLDKEVRYAYRGGFTWLNDRFKEKEIGEGMVFDVNSLYPAQMYSRLLPYGEPIVFEGKYVWDEDYPLHIQHIRCEFELKEGYIPTIQIKRSRFYKGNEYLKSSGGEIADLWLSNVDLELMKEHYDLYNVEYISGLKFKATTGLFKDFIDKWFYIKTTSYGAIKQLAKLMLNSLYGKFASNPDVTGKVPYLKENGALGFRLGEEETKDPVYTPMGVFITAWARYTTITAAQACYDRIIYCDTDSIHLTGTEIPDVIKDIVDPKKLGYWAHESTFKRAKYLRQKTYIQDIYMKEVMGYLVEGSPDDYTMIKFSVKCAGMTDKIKKEVTFENFKVGFSRKMKPKPVQVPGGVVLVDDTFTIK

SEQ ID NO: 103 - protein, 575 aa, Artificial
  mutant recombinant phi29-type DNA polymerase
MKHMPRKMYSCDFETTTKVEDCRVWAYGYMNIEDHSEYKIGNSLDEFMAWVLKVQADLYFHHLKFDGAFIINWLERNGFKWSADGLPNTYNTIISRMGQWYMIDICLGYKGKRKIHTVIYDSLKKLPFPVKKIAKDFKLTVLKGDIDYHKERPVGYKITPEEYAYIKNDIQIIAEALLIQFKQGLDRMTAGSDSLKGFKDIITTKKFKKVFPTLSLGLDKEVRYAYRGGFTWLNDRFKEKEIGEGMVFDVNSLYPAQMYSRLLPYGEPIVFEGKYVWDEDYPLHIQHIRCEFELKEGYIPTIQIKRSRFYKGNEYLKSSGGEIADLWLSNVDLELMKEHYDLYNVEYISGLKFKATTGLFKDFIDKWTYIKTTSYGAIKQLAKLMLNSLYGKFASNPDVTGKVPYLKENGALGFRLGEEETKDPVYTPMGVFITAWARYTTITAAQACYDRIIYCDTDSIHLTGTEIPDVIKDIVDPKKLGYWEHESTFKRAKYLRQKTYIQDIYMKRVDGYLVEGSPDDYTDIKFSVKCAGMTDKIKKEVTFENFKVGFSRKMKPKPVQVPGGVVLVDDTFTIK

SEQ ID NO: 104 - protein, 575 aa, Artificial
  mutant recombinant phi29-type DNA polymerase
MKHMPRKMYSCRFETTTKVEDCRVWAYGYMNIEDHSEYKIGNSLDEFMAWVLKVQADLYFHHLKFDGAFIINWLERNGFKWSADGLPNTYNTIISRMGQWYMIDICLGYKGKRKIHTVIYDSLKKLPFPVKKIAKDFKLTVLKGDIDYHKERPVGYKITPEEYAYIKNDIQIIAEALLIQFKQGLDRMTAGSDSLKGFKDIITTKKFKKVFPTLSLGLDKEVRYAYRGGFTWLNDRFKEKEIGEGMVFDVNSLYPAQMYSRLLPYGEPIVFEGKYVWDEDYPLHIQHIRCEFELKEGYIPTIQIKRSRFYKGNEYLKSSGGEIADLWLSNVDLELMKEHYDLYNVEYISGLKFKATTGLFKDFIDKWFYIKTTSYGAIKQLAKLMLNSLYGKFASNPDVTGKVPYLKENGALGFRLGEEETKDPVYTPMGVFITAWARYTTITAAQACYDRIIYCDTDSIHLTGTEIPDVIKDIVDPKKLGYWEHESTFKRAKYLRQKTYIQDIYMKEVDGYLVEGSPDDYTDIKFSVKCAGMTDKIKKEVTFENFKVGFSRKMKPKPVQVPGGVVLVDDTFTIK

SEQ ID NO: 105 - protein, 579 aa, Artificial
  mutant recombinant phi29-type DNA polymerase
MKHMPRKMYSCRFETTTKVEDCRVWAYGYMNIEDHSEYKIGNSLDEFMAWVLKVQADLYFHNLKFDGAFIINWLERNGFKWSADGLPNTYNTIISRMGQWYMIDICLGYKGKRKIHTVIYDSLKKLPFPVKKIAKDFKLTVLKGDIDYHKERPVGYKITPEEYAYIKNDIQIIAEALLIQFKQGLDRMTAGSDSLKGFKDIITTKKFKKVFPTLSLGLDKEVRYAYRGGFTWLNDRFKEKEIGEGMVFDVNSLYPAQMYSRLLPYGEPIVFEGKYVWDEDYPLHIQHIRCEFELKEGYIPTIQIKRSRFYKGNEYLKSSGGEIADLWLSNVDLELMKEHYDLYNVEYISGLKFKATTGLFKDFIDKWFYIKTTSYGAIKQLAKLMLNSLYGKFASNPDVTGKVPYLKENGALGFRLGEEETKDPVYTPMGVFITAWARYTTITAAQACYDRIIYCDTDSIHLTGTEIPDVIKDIVDPKKLGYWEHESTFKRAKYLRQKTYIQDIYMKRVDGKSKGSLVEGSPDDYTDIKFSVKCAGMTDKIKKEVTFENFKVGFSRKMKPKPVQVPGGVVLVDDTFTIK

SEQ ID NO: 106 - protein, 579 aa, Artificial
  mutant recombinant phi29-type DNA polymerase
MKHMPRKMYSCRFETTTKVEDCRVWAYGYMNIEDHSEYKIGNSLDEFMAWVLKVQADLYFHNLKFDGAFIINWLERNGFKWSADGLPNTYNTIISRMGQWYMIDICLGYKGKRKIHTVIYDSLKKLPFPVKKIAKDFKLTVLKGDIDYHKERPVGYKITPEEYAYIKNDIQIIAEALLIQFKQGLDRMTAGSDSLKGFKDIITTKKFKKVFPTLSLGLDKEVRYAYRGGFTWLNDRFKEKEIGEGMVFDVNSLYPAQMYSRLLPYGEPIVFEGKYVWDEDYPLHIQHIRCEFELKEGYIPTIQIKRSRFYKGNEYLKSSGGEIADLWLSNVDLELMKEHYDLYNVEYISGLKFKATTGLFKDFIDKWFYIKTTSYGAWKQLAKLMLNSLYGKFASNPDVTGKVPYLKENGALGFRLGEEETKDPVYTPMGVFITAWARYTTITAAQACYDRIIYCDTDSIHLTGTEIPDVIKDIVDPKKLGYWEHESTFKRAKYLRQKTYIQDIYMKRVDGKSKGSLVEGSPDDYTDIKFSVKCAGMTDKIKKEVTFENFKVGFSRKMKPKPVQVPGGVVLVDDTFTIK

SEQ ID NO: 107 - protein, 575 aa, Artificial
  mutant recombinant phi29-type DNA polymerase
MKHMPRKMYSCDFETTTKVEDCRVWAYGYMNIEDHSEYKIGNSLDEFMAWVLKVQADLYFHNLKFDGAFIINWLERNGFKWSADGLPNTYNTIISRMGQWYMIDICLGYKGKRKIHTVIYDSLKKLPFPVKKIAKDFKLTVLKGDIDAHKERPVGYKITPEEYAYIKNDIQIIAEALLIQFKQGLDRMTAGSDSLKGFKDIITTKKFKKVFPTLSLGLDKEVRYAYRGGFTWLNDRFKEKEIGEGMVFDVNSLYPAQMYSRLLPYGEPIVFEGKYVWDEDYPLHIQHIRCEFELKEGYIPTIQIKRSRFYKGNEYLKSSGGEIADLWLSNVDLELMKEHYDLYNVEYISGLKFKATTGLFKDFIDKWTYIKTTSYGAIKQLAKLMLNSLYGKFASNPDVTGKVPYLKENGALGFRLGEEETKDPVYTPMGVFITAWARYTTITAAQACYDRIIYCDTDSIHLTGTEIPDVIKDIVDPKKLGYWEHESTFKRAKYLRQKTYIQDIYMKEVDGYLVEGSPDDYTDIKFSVKCAGMTDKIKKEVTFENFKVGFSRKMKPKPVQVPGGVVLVDDTFTIK

SEQ ID NO: 108 - protein, 575 aa, Artificial
  mutant recombinant phi29-type DNA polymerase
MKHMPRKMYSCDFETTTKVEDCRVWAYGYMNIEDHSEYKIGNSLDEFMAWVLKVQADLYFHDLKFDGAFIINWLERNGFKWSADGLPNTYNTIISRMGQWYMIDICLGYKGKRKIHTVIYDSLKKLPFPVKKIAKDFKLTVLKGDIDYHKERPVGYKITPEEYAYIKNDIQIIAEALLIQFKQGLDRMTEGSDSLKGFKDIITTKKFKKVFPTLSLGLDKEVRYAYRGGFTWLNDRFKEKEIGEGMVFDVNSLYPAQMYSRLLPYGEPIVFEGKYVWDEDYPLHIQHIRCEFELKEGYIPTIQIKRSRFYKGNEYLKSSGGEIADLWLSNVDLELMKEHYDLYNVEYISGLKFKATTGLFKDFIDKWTYIKTTSYGAIKQLAKLMLNSLYGKFASNPDVTGKVPYLKENGALGFRLGEEETADPVYTPMGVFITAWARYTTITAAQACYDRIIYCDTDSIHLTGTEIPDVIKDIVDPKKLGYWEHESTFKRAKYLRQKTYIQDIYMKRVDGYLVEGSPDDYTDIKFSVKCAGMTDKIKKEVTFENFKVGFSRKMKPKPVQVPGGVVLVDDTFTIK

SEQ ID NO: 109 - protein, 579 aa, Artificial
  mutant recombinant phi29-type DNA polymerase
MKHMPRKMYSCDFETTTKVEDCRVWAYGYMNIEDHSEYKIGNSLDEFMAWVLKVQADLYFHDLKFDGAFIINWLERNGFKWSADGLPNTYNTYISRMGQWYMIDICLGYKGKRKIHTVIYDSLKKLPFPVKKIAKDFKLTVLKGDIDYHKERPVGYKITPEEYAYIKNDIQIIAEALLIQFKQGLDRMTAGSDSLKGFKDIITTKKFKKVFPTLSLGLDKEVRYAYRGGFTWLNDRFKEKEIGEGMVFDVNSLYPAQMYSRLLPYGEPIVFEGKYVWDEDYPLHIQHIRCEFELKEGYIPTIQIKRSRFYKGNEYLKSSGGEIADLWLSNVDLELMKEHYDLYNVEYISGLKFKATTGLFKDFIDKWFYIKYTSYGAWKQLAKLMLNSLYGKFASNPDVTGKVPYLKENGALGFRLGEEETKDPVYTPMGVFITAWARYTTITAAQACYDRIIYCDTDSIHLTGTEIPDVIKDIVDPYKLGYWEHESTFKRAKYLRQKTYIQDIYMKRVDGKSYGSLVEGSPDDYTDIKFSVKCAGMTDKIKKEVTFENFKVGFSRKMKPKPVQVPGGVVLVDDTFTIK

SEQ ID NO: 110 - protein, 575 aa, Artificial
  mutant recombinant phi29-type DNA polymerase
MKHMPRKMYSCDFETTTKVEDCRVWAYGYMNIEDHSEYKIGNSLDEFMAWVLKVQADLYFHDLKFDGAFIINWLERNGFKWSADGLPNTYNTIISRMGQWYMIDICLGYKGKRKIHTVIYDSLKKLPFPVKKIAKDFKLTVLKGDIDYHKERPVGYKITPEEYAYIKNDIQIIAEALLIQFKQGLDRMTAGSDSLKGFKDIITTKKFKKVFPTLSLGLDKEVRYAYRGGFTWLNDRFKEKEIGEGMVFDVNSLYPAQMYSRLLPYGEPIVFEGKYVWDEDYPLHIQHIRCEFELKEGYIPTIQIKRSRFYKGNEYLKSSGGEIADLWLSNVDLELMKEHYDLYNVEYISGLKFKATTGLFKDFIDKWFYIKTTSYGAIKQLAKLMLNSLYGKFASNPDVTGKVPYLKENGALGFRLGEEETKDPVYTPMGVFITAWARYTTITAAQACYDRIIYCDTDSIHLTGTEIPDVIKDIVDQKKLGYWEHESTFKRAKYLRQKTYIQDIYMKEVDGYLVEGSPDDYTDIKFSVKCAGMTDKIKKEVTFENFKVGFSRKMKPKPVQVPGGVVLVDDTFTIK

SEQ ID NO: 111 - protein, 575 aa, Artificial
  mutant recombinant phi29-type DNA polymerase
MKHMPRKMYSCDFETTTKVEDCRVWAYGYMNIEDHSEYKIGNSLDEFMAWVLKVQADLYFHDLKFDGAFIINWLERNGFKWSADGLPNTYNTIISRMGQWYMIDICLGYKGKRKIHTVIYDSLKKLPFPVKKIAKDFKLTVLKGDIDYHKERPVGYKITPEEYAYIKNDIQIIAEALLIQFKQGLDRMTAGSDSLKGFKDIITTKKFKKVFPTLSLGLDKEVRYAYRGGFTWLNDRFKEKEIGEGMVFDVNSLYPAQMYSRLLPYGEPIVFEGKYVWDEDYPLHIQHIRCEFELKEGYIPTIQIKRSRFYKGNEYLKSSGGEIADLWLSNVDLELMKEHYDLYNVEYISGLKFKATTGLFKDFIDKWFYIKTTSYGAIKQLAKMMLNSLYGKFASNPDVTGKVPYLKENGALGFRLGEEETKDPVYTPMGVFITAWARYTTITAAQACYDRIIYCDTDSIHLTGTEIPDVIKDIVDPKKLGYWEHESTFKRAKYLRQKTYIQDIYMKEVDGYLVEGSPDDYTDIKFSVKCAGMTDKIKKEVTFENFKVGFSRKMKPKPVQVPGGVVLVDDTFTIK

SEQ ID NO: 112 - protein, 575 aa, Artificial
  mutant recombinant phi29-type DNA polymerase
MKHMPRKMYSCDFETTTKVEDCRVWAYGYMNIEDHSEYKIGNSLDEFMAWVLKVQADLYFHNLKFDGAFIINWLERNGFKWSADGLPNTYNTIISRMGQWYMIDICLGYKGKRKIHTVIYDSLKKLPFPVKKIAKDFKLTVLKGDIDYHKERPVGYKITPEEYAYIKNDIQIIAEALLIQFKQGLDRMTAGSDSLKGFKDIITTKKFKKVFPTLSLGLDKEVRYAYRGGFTWLNDRFKEKEIGEGMVFDVNSLYPAQMYSRLLPYGEPIVFEGKYVWDEDYPLHIQHIRCEFELKEGYIPTIQIKRSRFYKGNEYLKSSGGEIADLWLSNVDLELMKEHYDLYNVEYISGLKFKATTGLFKDFIDKWFYIKTTSYGAIKQLAKLMLNSLYGKFASNPDVTGKVPYLKENGALGFRLGEEETKDPVYTPMGVFITAWARYTTITAAQACYDRIIYCDTDSIHLTGTEIPDVIKDIVDEKKLGYWAHESTFKRAKYLRQKTYIQDIYMKEVDGYLVEGSPDDYTDIKFSVKCAGMTDKIKKEVTFENFKVGFSRKMKPKPVQVPGGVVLVDDTFTIK

SEQ ID NO: 113 - protein, 575 aa, Artificial
  mutant recombinant phi29-type DNA polymerase
MKHMPRKMYSCDFETTTKVEDCRVWAYGYMNIEDHSEYKIGNSLDEFMAWVLKVQADLYFHNLKFDGAFIINWLERNGFKWSADGLPNTYNTIISRMGQWYMIDICLGYKGKRKIHTVIYDSLKKLPFPVKKIAKDFKLTVLKGDIDYHKERPVGYKITPEEYAYIKNDIQIIAEVLLIQFKQGLDRMTAGSDSLKGFKDIITTKKFKKVFPTLSLGLDKEVRYAYRGGFTWLNDRFKEKEIGEGMVFDVNSLYPAQMYSRLLPYGEPIVFEGKYVWDEDYPLHIQHIRCEFELKEGYIPTIQIKRSRFYKGNEYLKSSGGEIADLWLSNVDLELMKEHYDLYNVEYISGLKFKATTGLFKDFIDKWFYIKTTSYGAIKQLAKLMLNSLYGKFASNPDVTGKVPYLKENGALGFRLGEEETKDPVYTPMGVFITAWARYTTITAAQACYDRIIYCDTDSIHLTGTEIPDVIKDIVDPKKLGYWAHESTFKRAKYLRQKTYIQDIYMKEVDGYLVEGSPDDYTDIKFSVKCAGMTDKIKKEVTFENFKVGFSRKMKPKPVQVPGGVVLVDDTFTIK

SEQ ID NO: 114 - protein, 575 aa, Artificial
  mutant recombinant phi29-type DNA polymerase
MKHMPRKMYSCDFETTTKVEDCRVWAYGYMNIEDHSEYKIGNSLDEFMAWVLKVQADLYFHNLKFDGAFIINWLERNGFKWSADGLPNTYNTIISRMGQWYMIDICLGYKGKRKIHTVIYDSLKKLPFPVKKIAKDFKLTVLKGDIDYHKERPVGYKITPEEYAYIKNDIQIIAEALLIQFKQGLDRMTAGSDSLKGFKDIITTKKFKKVFPTLSLGLDKEVRYAYRGGFTWLNDRFKEKEIGEGMVFDVNSLYPAQMYSRLLPYGEPIVFEGKYVWDEDYPLHIQHIRCEFELKEGYIPTIQIKRSRFYKGNEYLKSSGGEIADLWLSNVDLELMKEHYDLYNVEYISGLKFKATTGLFKDFIDKWFYIKTTSYGAIKQLAKLMLNSLYGKFASNPDVTGKVPYLKENGALGFRLGEEETRDPVYTPMGVFITAWARYTTITAAQACYDRIIYCDTDSIHLTGTEIPDVIKDIVDPKKLGYWAHESTFKRAKYLRQKTYIQDIYMKEVDGYLVEGSPDDYTDIKFSVKCAGMTDKIKKEVTFENFKVGFSRKMKPKPVQVPGGVVLVDDTFTIK

SEQ ID NO: 115 - protein, 575 aa, Artificial
  mutant recombinant phi29-type DNA polymerase
MKHMPRKMYSCDFETTTKVEDCRVWAYGYMNIEDHSEYKIGNSLDEFMAWVLKVQADLYFHDLKFDGAFIINWLERNGFKWSADGLPNTYNTIISRMGQWYMIDICLGYKGKRKIHTVIYDSLKKLPFPVKKIAKDFKLTVLKGDIDYHKERPVGYKITPEEYAYIKNDIQIIAEALLIQFKQGLDRMTAGSDSLKGFKDIITTKKFKKVFPTLSLGLDKEVRYAYRGGFTWLNDRFKEKEIGEGMVFDVNSLYPAQMYSRLLPYGEPIVFEGKYVWDEDYPLHIQHIRCEFELKEGYIPTIQIKRSRFYKGNEYLKSSGGEIADLWLSNVDLELMKEHYDLYNVEYISGLKFKATTGLFKDFIDKWTYIKTTSYGAIKQLAKLMLNSLYGKFASNPDVTGKVPYLKENGALGFRLGEEETKDPVYTPMGVFITAWARYTTITAAQACYDRIIYCDTDSIHLTGTEIPDVIKDIVDQKKLGYWEHESTFKRAKYLRQKTYIQDIYMKEVDGYLVEGSPDDYTDIKFSVKCAGMTDKIKKEVTFENFKVGFSRKMKPKPVQVPGGVVLVDDTFTIK

SEQ ID NO: 116 - protein, 575 aa, Artificial
  mutant recombinant phi29-type DNA polymerase
MKHMPRKMYSCDFETTTKVEDCRVWAYGYMNIEDHSEYKIGNSLDEFMAWVLKVQADLYFHNLKFDGAFIINWLERNGFKWSADGLPNTYNTFISRMGQWYMIDICLGYKGKRKIHTVIYDSLKKLPFPVKKIAKDFKLTVLKGDIDYHKERPVGYKITPEEYAYIKNDIQIIAEALLIQFKQGLDRMTAGSDSLKGFKDIITTKKFKKVFPTLSLGLDKEVRYAYRGGFTWLNDRFKEKEIGEGMVFDVNSLYPAQMYSRLLPYGEPIVFEGKYVWDEDYPLHIQHIRCEFELKEGYIPTIQIKRSRFYKGNEYLKSSGGEIADLWLSNVDLELMKEHYDLYNVEYISGLKFKATTGLFKDFIDKWFYIKTTSYGAIKQLAKLMLNSLYGKFASNPDVTGKVPYLKENGALGFRLGEEETKDPVYTPMGVFITAWARYTTITAAQACYDRIIYCDTDSIHLTGTEIPDVIKDIVDPKKLGYWEHESTFKRAKYLRQKTYIQDIYMKEVDGYLVEGSPDDYTDIKFSVKCAGMTDKIKKEVTFENFKVGFSRKMKPKPVQVPGGVVLVDDTFTIK

SEQ ID NO: 117 - protein, 575 aa, Artificial
  mutant recombinant phi29-type DNA polymerase
MKHMPRKMYSCDFETTTKVEDCRVWAYGYMNIEDHSEYKIGNSLDEFMAWVLKVQADLYFHNLKFDGAFIINWLERNGFKWSADGLPNTYNTIISRMGQWYMIDICLGYKGKRKIHTVIYDSLKKLPFPVKKIAKDFKLTVLKGDIDYHKERPVGYKITPEEYAYIKNDIQIIAEALLIQFKQGLDRMTAGSDSLKGFKDIITTKKFKKVFPTLSLGLDKEVRYAYRGGFTWLNDRFKEKEIGEGMVFDVNSAYPAQMYSRLLPYGEPIVFEGKYVWDEDYPLHIQHIRCEFELKEGYIPTIQIKRSRFYKGNEYLKSSGGEIADLWLSNVDLELMKEHYDLYNVEYISGLKFKATTGLFKDFIDKWTYIKTTSYGAIKQLAKLMLNSLYGKFASNPDVTGKVPYLKENGALGFRLGEEETKDPVYTPMGVFITAWARYTTITAAQACYDRIIYCDTDSIHLTGTEIPDVIKDIVDPKKLGYWEHESTFKRAKYLRQKTYIQDIYMKEVDGYLVEGSPDDYTDIKFSVKCAGMTDKIKKEVTFENFKVGFSRKMKPKPVQVPGGVVLVDDTFTIK

SEQ ID NO: 118 - protein, 575 aa, Artificial
  mutant recombinant phi29-type DNA polymerase
MKHMPRKMYSCDFETTTKVEDCRVWAYGYMNIEDHSEYKIGNSLDEFMAWVLKVQADLYFHDLKFDGAFIINWLERNGFKWSADGLPNTYNTIISRMGQWYMIDICLGYKGKRKIHTVIYDSLKKLPFPVKKIAKDFKLTVLKGDIDYHKERPVGYKITPEEYAYIKNDIQIIAEALLIQFKQGLDRMTAGSDSLKGFKDIITTKKFKKVFPTLSLGLDKEVRYAYRGGFTWLNDRFKEKEIGEGMVFDVNSAYPAQMYSRLLPYGEPIVFEGKYVWDEDYPLHIQHIRCEFELKEGYIPTIQIKRSRFYKGNEYLKSSGGEIADLWLSNVDLELMKEHYDLYNVEYISGLKFKATTGLFKDFIDKWTYIKTTSYGAIKQLAKLMLNSLYGKFASNPDVTGKVPYLKENGALGFRLGEEMTKDPVYTPMGVFITAWARYTTITAAQACYDRIIYCDTDSIHLTGTEIPDVIKDIVDPKKLGYWEHESTFKRAKYLRQKTYIQDIYMKEVDGYLVEGSPDDYTDIKFSVKCAGMTDKIKKEVTFENFKVGFSRKMKPKPVQVPGGVVLVDDTFTIK

SEQ ID NO: 119 - protein, 575 aa, Artificial
  mutant recombinant phi29-type DNA polymerase
MKHMPRKMYSCDFETTTKVEDCRVWAYGYMNIEDHSEYKIGNSLDEFMAWVLKVQADLYFHDLKFDGAFIINWLERNGFKWSADGLPNTYNTIISRMGQWYMIDICLGYKGKRKIHTVIYDSLKKLPFPVKKIAKDFKLTVLKGDIDYHKERPVGYKITPEEYAYIKNDIQIIAEALLIQFKQGLDRMTAGSDSLKGFKDIITTKKFKKVFPTLSLGLDKEVRYAYRGGFTWLNDRFKEKEIGEGMVFDVNSAYPAQMYSRLLPYGEPIVFEGKYVWDEDYPLHIQHIRCEFELKEGYIPTIQIKRSRFYKGNEYLKSSGGEIADLWLSNVDLELMKEHYDLYNVEYISGLKFKATTGLFKDFIDKWTYIKTTSYGAIKQLAKLMLNSLYGKFASNPDVTGKVPYLKENGALGFRLGEEETADPVYTPMGVFITAWARYTTITAAQACYDRIIYCDTDSIHLTGTEIPDVIKDIVDPKKLGYWEHESTFKRAKYLRQKTYIQDIYMKEVDGYLVEGSPDDYTDIKFSVKCAGMTDKIKKEVTFENFKVGFSRKMKPKPVQVPGGVVLVDDTFTIK

SEQ ID NO: 120 - protein, 575 aa, Artificial
  mutant recombinant phi29-type DNA polymerase
MKHMPRKMYSCDFETTTKVEDCRVWAYGYMNIEDHSEYKIGNSLDEFMAWVLKVQADLYFHDLKFDGAFIINWLERNGFKWSADGLPNTYNTIISRMGQWYMIDICLGYKGKRKIHTVIYDSLKKLPFPVKKIAKDFKLTVLKGDIDYHKERPVGYKITPEEYAYIKNDIQIIAEALLIQFKQGLDRMTAGSDSLKGFKDIITTKKFKKVFPTLSLGLDKEVRYAYRGGFTWLNDRFKEKEIGEGMVFDVNSAYPAQMYSRLLPYGEPIVFEGKYVWDEDYPLHIQHIRCEFELKEGYIPTIQIKRSRFYKGNEYLKSSGGEIADLWLSNVDLELMKEHYDLYNVEYISGLKFKATTGLFKDFIDKWTYIKTTSYGAIKQLAKLMLNSLYGKFASNPDVTGKVPYLKENGALGFRLGEEETKDPVYTPMGVFITAWARYTTITAAQACYDRIIYCDTDSIHLTGTEIPDVIKDIVDPKKLGYWEHESTFKRAKYLRQKTYIQDIYMKKVDGYLVEGSPDDYTDIKFSVKCAGMTDKIKKEVTFENFKVGFSRKMKPKPVQVPGGVVLVDDTFTIK

SEQ ID NO: 121 - protein, 575 aa, Artificial
  mutant recombinant phi29-type DNA polymerase
MKHMPRKMYSCDFETTTKVEDCRVWAYGYMNIEDHSEYKIGNSLDEFMAWVLKVQADLYFHDLKFDGAFIINWLERNGFKWSADGLPNTYNTIISRMGQWYMIDICLGYKGKRKIHTVIYDSLKKLPFPVKKIAKDFKLTVLKGDIDYHKERPVGYKITPEEYAYIKNDIQIIAEALLIQFKQGLDRMTAGSDSLKGFKDIITTKKFKKVFPTLDLGLDKEVRYAYRGGFTWLNDRFKEKEIGEGMVFDVNSAYPAQMYSRLLPYGEPIVFEGKYVWDEDYPLHIQHIRCEFELKEGYIPTIQIKRSRFYKGNEYLKSSGGEIADLWLSNVDLELMKEHYDLYNVEYISGLKFKATTGLFKDFIDKWTYIKTTSYGAIKQLAKLMLNSLYGKFASNPDVTGKVPYLKENGALGFRLGEEETKDPVYTPMGVFITAWARYTTITAAQACYDRIIYCDTDSIHLTGTEIPDVIKDIVDPKKLGYWEHESTFKRAKYLRQKTYIQDIYMKEVDGYLVEGSPDDYTDIKFSVKCAGMTDKIKKEVTFENFKVGFSRKMKPKPVQVPGGVVLVDDTFTIK

SEQ ID NO: 122 - protein, 575 aa, Artificial
  mutant recombinant phi29-type DNA polymerase
MKHMPRKMYSCDFETTTKVEDCRVWAYGYMNIEDHSEYKIGNSLDEFMAWVLKVQADLYFHDLKFDGAFIINWLERNGFKWSADGLPNTYNTIISRMGQWYMIDICLGYKGKRKIHTVIYDSLKKLPFPVKKIAKDFKLTVLKGDIDYHKERPVGYKITPEEYAYIKNDIQIIAEALLIQFKQGLDRMTAGSDSLKGFKDIITTKKFKKVFPTLSLGLDKEVRYAYRGGFTWLNDRFKEKEIGEGMVFDVNSTYPAQMYSRLLPYGEPIVFEGKYVWDEDYPLHIQHIRCEFELKEGYIPTIQIKRSRFYKGNEYLKSSGGEIADLWLSNVDLELMKEHYDLYNVEYISGLKFKATTGLFKDFIDKWTYIKTTSYGAIKQLAKLMLNSLYGKFASNPDVTGKVPYLKENGALGFRLGEEETKDPVYTPMGVFITAWARYTTITAAQACYDRIIYCDTDSIHLTGTEIPDVIKDIVDPKKLGYWEHESTFKRAKYLRQKTYIQDIYMKEVDGYLVEGSPDDYTDIKFSVKCAGMTDKIKKEVTFENFKVGFSRKMKPKPVQVPGGVVLVDDTFTIK

SEQ ID NO: 123 - protein, 575 aa, Artificial
  mutant recombinant phi29-type DNA polymerase
MKHMPRKMYSCDFETTTKVEDCRVWAYGYMNIEDHSEYKIGNSLDEFMAWVLKVQADLYFHDLKFDGAFIINWLERNGFKWSADGLPNTYNTIISRMGQWYMIDICLGYKGKRKIHTVIYDSLKKLPFPVKKIAKDFKLTVLKGDIDYHKERPVGYKITPEEYAYIKNDIQIIAEALLIQFKQGLDRMTAGSDSLKGFKDIITTKKFKKVFPTLSLGLDKEVRYAYRGGFTWLNDRFKEKEIGEGMVFDVNSAYPAQMYSRLLPYGEPIVFEGKYVWDEDYPLHIQHIRCEFELKEGYIPTIQIKRSRFYKGNEYLKSSGGEIADLWLSNVDLELMKEHYDLYNVEYISGLKFKATTGLFKDFIDKWTHIKTTSYGAIKQLAKLMLNSLYGKFASNPDVTGKVPYLKENGALGFRLGEEETKDPVYTPMGVFITAWARYTTITAAQACYDRIIYCDTDSIHLTGTEIPDVIKDIVDPKKLGYWEHESTFKRAKYLRQKTYIQDIYMKEVDGYLVEGSPDDYTDIKFSVKCAGMTDKIKKEVTFENFKVGFSRKMKPKPVQVPGGVVLVDDTFTIK

SEQ ID NO: 124 - protein, 575 aa, Artificial
  mutant recombinant phi29-type DNA polymerase
MKHMPRKMYSCDFETTTKVEDCRVWAYGYMNIEDHSEYKIGNSLDEFMAWVLKVQADLYFHDLKFDGAFIINWLERNGFKWSADGLPNTYNTIISRMGQWYMIDICLGYKGKRKIHTVIYDSLKKLPFPVKKIAKDFKLTVLKGDIDYHKERPVGYKITPEEYAYIKNDIQIIAEALLIQFKQGLDRMTAGSDSLKGFKDIITTKKFKKVFPTLSLGLDKEVRYAYRGGFTWLNDRFKEKEIGEGMVFDVNSAYPAQMYSRLLPYGEPIVFEGKYVWDEDYPLHIQHIRCEFELKEGYIPTIQIKRSRFYKGNEYLKSSGGEIADLWLSNVDLELMKEHYDLYNVEYISGLKFKATTGLFKDFIDKWTGIKTTSYGAIKQLAKLMLNSLYGKFASNPDVTGKVPYLKENGALGFRLGEEETKDPVYTPMGVFITAWARYTTITAAQACYDRIIYCDTDSIHLTGTEIPDVIKDIVDPKKLGYWEHESTFKRAKYLRQKTYIQDIYMKEVDGYLVEGSPDDYTDIKFSVKCAGMTDKIKKEVTFENFKVGFSRKMKPKPVQVPGGVVLVDDTFTIK

SEQ ID NO: 125 - protein, 575 aa, Artificial
  mutant recombinant phi29-type DNA polymerase
MKHMPRKMYSCDFETTTKVEDCRVWAYGYMNIEDHSEYKIGNSLDEFMAWVLKVQADLYFHDLKFDGAFIINWLERNGFKWSADGLPNTYNTIISRMGQWYMIDICLGYKGKRKIHTVIYDSLKKLPFPVKKIAKDFKLTVLKGDIDYHKERPVGYKITPEEYAYIKNDIQIIAEALLIQFKQGLDRMTAGSDSLKGFKDIITTKKFKKVFPTLSLGLDKEVRYAYRGGFTWLNDRFKEKEIGEGMVFDVNSAYPAQMYSRLLPYGEPIVFEGKYVWDEDYPLHIQHIRCEFELKEGYIPTIQIKRSRFYKGNEYLKSSGGEIADLWLSNVDLELMKEHYDLYNVEYISGLKFKATTGLFKDFIDKWTLIKTTSYGAIKQLAKLMLNSLYGKFASNPDVTGKVPYLKENGALGFRLGEEETKDPVYTPMGVFITAWARYTTITAAQACYDRIIYCDTDSIHLTGTEIPDVIKDIVDPKKLGYWEHESTFKRAKYLRQKTYIQDIYMKEVDGYLVEGSPDDYTDIKFSVKCAGMTDKIKKEVTFENFKVGFSRKMKPKPVQVPGGVVLVDDTFTIK

SEQ ID NO: 126 - protein, 575 aa, Artificial
  mutant recombinant phi29-type DNA polymerase
MKHMPRKMYSCDFETTTKVEDCRVWAYGYMNIEDHSEYKIGNSLDEFMAWVLKVQADLYFHDLKFDGAFIINWLERNGFKWSADGLPNTYNTIISRMGQWYMIDICLGYKGKRKIHTVIYDSLKKLPFPVKKIAKDFKLTVLKGDIDYHKERPVGYKITPEEYAYIKNDIQIIAEALLIQFKQGLDRMTAGSDSLKGFKDIITTKKFKKVFPTLSLGLDKEVRYAYRGGFTWLNDRFKEKEIGEGMVFDVNSAYPAQMYSRLLPYGEPIVFEGKYVWDEDYPLHIQHIRCEFELKEGYIPTIQIKRSRFYKGNEYLKSSGGEIADLWLSNVDLELMKEHYDLYNVEYISGLKFKATTGLFKDFIDKWTYIKTTSFGAIKQLAKLMLNSLYGKFASNPDVTGKVPYLKENGALGFRLGEEETKDPVYTPMGVFITAWARYTTITAAQACYDRIIYCDTDSIHLTGTEIPDVIKDIVDPKKLGYWEHESTFKRAKYLRQKTYIQDIYMKEVDGYLVEGSPDDYTDIKFSVKCAGMTDKIKKEVTFENFKVGFSRKMKPKPVQVPGGVVLVDDTFTIK

SEQ ID NO: 127 - protein, 575 aa, Artificial
  mutant recombinant phi29-type DNA polymerase
MKHMPRKMYSCDFETTTKVEDCRVWAYGYMNIEDHSEYKIGNSLDEFMAWVLKVQADLYFHNLKFRGAFIINWLERNGFKWSADGLPNTYNTIISRMGQWYMIDICLGYKGKRKIHTVIYDSLKKLPFPVKKIAKDFKLTVLKGDIDYHKERPVGYKITPEEYAYIKNDIQIIAEALLIQFKQGLDRMTAGSDSLKGFKDIITTKKFKKVFPTLSLGLDKEVRYAYRGGFTWLNDRFKEKEIGEGMVFDVNSAYPAQMYSRLLPYGEPIVFEGKYVWDEDYPLHIQHIRCEFELKEGYIPTIQIKRSRFYKGNEYLKSSGGEIADLWLSNVDLELMKEHYDLYNVEYISGLKFKATTGLFKDFIDKWTYIKTTSYGAIKQLAKLMLNSLYGKFASNPDVTGKVPYLKENGALGFRLGEEETKDPVYTPMGVFITAWARYTTITAAQACYDRIIYCDTDSIHLTGTEIPDVIKDIVDPKKLGYWEHESTFKRAKYLRQKTYIQDIYMKEVDGYLVEGSPDDYTDIKFSVKCAGMTDKIKKEVTFENFKVGFSRKMKPKPVQVPGGVVLVDDTFTIK

SEQ ID NO: 128 - protein, 575 aa, Artificial
  mutant recombinant phi29-type DNA polymerase
MKHMPRKMYSCDFETTTKVEDCRVWAYGYMNIEDHSEYKIGNSLDEFMAWVLKVQADLYFHDLKFDGAFIINWLERNGFKWSADGLPNTYNTIISRMGQWYMIDICLGYKGKRKIHTVIYDSLKKLPFPVKKIAKDFKLTVLKGDIDYHKERPVGYKITPEEYAYIKNDIQIIAEALLIQFKQGLDRMTAGSDSLKGFKDIITTKKFKKVFPTLSLGLDKEVRYAYRGGFTWLNDRFKEKEIGEGMVFDVNSAYPAQMYSRLLPYGEPIVFEGKYVWDEDYPLHIQHIRCEFELKEGYIPTIQIKRSRFYKGNEYLKSSGGEIADLWLSNVDLELMKEHYDLYNVEYISGLKFKATTGLFKDFIDKWTYIKTTSYGAIKQLAKLMLNSLYGKFASNPDVTGKVPYLKENGALGFRLGEEETKDPVYTPMGVFITAWARYTTITAAQACYDRIIYCDTDSIHLTGTEIPDVIKDIVDPKKLGYWEHESTFKRAKYLRQKTYIQDRYMKEVDGYLVEGSPDDYTDIKFSVKCAGMTDKIKKEVTFENFKVGFSRKMKPKPVQVPGGVVLVDDTFTIK

SEQ ID NO: 129 - protein, 575 aa, Artificial
  mutant recombinant phi29-type DNA polymerase
MKHMPRKMYSCDFETTTKVEDCRVWAYGYMNIEDHSEYKIGNSLDEFMAWVLKVQADLYFHDLKFDGAFIINWLERNGFKWSADGLPNTYNTIISRMGQWYMIDICLGYKGKRKIHTVIYDSLKKLPFPVKKIAKDFKLTVLKGDIDYHKERPVGYKITPEEYAYIKNDIQIIAEALLIQFKQGLDRMTAGSDSLKGFKDIITTKKFKKVFPTLSLGLDKEVRYAYRGGFTWLNDRFKEKEIGEGMVFDVNSAYPAQMYSRLLPYGEPIVFEGKYVWDEDYPLHIQHIRCEFELKEGYIPTIQIKRSRFYKGNEYLKSSGGEIADLWLSNVDLELMKEHYDLYNVEYISGLKFKATTGLFKDFIDKWTYIKTTSYGAIKQLAKLMLNSLYGKFASNPDVTGKVPYLKENGALGFRLGEEETKDPVYTPMGVFITAWARYTTITAAQACYDRIIYCDTDSIHLTGTEIPDVIKDIVDPKKLGYWEHESTFKRAKYLRQKTYIQDIYMKEVKGYLVEGSPDDYTDIKFSVKCAGMTDKIKKEVTFENFKVGFSRKMKPKPVQVPGGVVLVDDTFTIK

SEQ ID NO: 130 - protein, 575 aa, Artificial; identical to SEQ ID NO: 117
  mutant recombinant phi29-type DNA polymerase

SEQ ID NO: 131 - protein, 575 aa, Artificial; identical to SEQ ID NO: 117
  mutant recombinant phi29-type DNA polymerase

SEQ ID NO: 132 - protein, 575 aa, Artificial
  mutant recombinant phi29-type DNA polymerase
MKHMPRKMYSCDFETTTKVEDCRVWAYGYMNIEDHSEYKIGNSLDEFMAWVLKVQADLYFHNLKFDGAFIINWLERNGFKWSADGLPNTYNTIISRMGQWYMIDICLGYKGKRKIHTVIYDSLKKLPFPVKKIAKDFKLTVLKGDIDYHKERPVGYKITPEEYAYIKNDIQIIAEALLIQFKQGLDRMTAGSDSLKGFKDIITTKKFKKVFPTLSLGLDKEVRYAYRGGFTWLNDRFKEKEIGEGMVFDVNSAYPAQMYSRLLPYGEPIVFEGKYVWDEDYPLHIQHIRCEFELKEGYIPTIQIKRSRFYKGNEYLKSSGGEIADLWLSNVDLELMKEHYDLYNVEYISGLKFKATTGLFKDFIDKWTYIKTTSYGAIKQLAKLMLNSLYGKFASNPDVTGKVPYLKENGALGFRLGEEETKDPVYTPMGVFITAWARYTTITAAQACYDRIIYCDTDSIHLTGTEIPDVIKDIVDPKKLGYWEHESTFKRAKYLRQKTYIQDIYMKRVDGYLVEGSPDDYTDIKFSVKCAGMTDKIKKEVTFENFKVGFSRKMKPKPVQVPGGVVLVDDTFTIK

SEQ ID NO: 133 - protein, 627 aa, Artificial; identical to SEQ ID NO: 90
  mutant recombinant phi29-type DNA polymerase

SEQ ID NO: 134 - protein, 627 aa, Artificial
  mutant recombinant phi29-type DNA polymerase
MSVDGLNDFFEAQKIEWHEAMGHHHHHHHHHHSSGHIEGRHMKHMPRKMYSCDFETTTKVEDCRVWAYGYMNIEDHSEYKIGNSLDEFMAWVLKVQADLYFHNLKFDGAFIINWLERNGFKWSADGLPNTYNTIISRMGQWYMIDICLGYKGKRKIHTVIYDSLKKLPFPVKKIAKDFKLTVLKGDIDYHKERPVGYKITPEEYAYIKNDIQIIAEALLIQFKQGLDRMTAGSDSLKGFKDIITTKKFKKVFPTLSLGLDKEVRYAYRGGFTWLNDRFKEKEIGEGMVFDVNSAYPAQMYSRLLPYGEPIVFEGKYVWDEDYPLHIQHIRCEFELKEGYIPTIQIKRSRFYKGNEYLKSSGGEIADLWLSNVDLELMKEHYDLYNVEYISGLKFKATTGLFKDFIDKWTYIKTTSYGAIKQLAKLMLNSLYGKFASNPDVTGKVPYLKENGALGFRLGEEETKDPVYTPMGVFITAWARYTTITAAQACYDRIIYCDTDSIHLTGTEIPDVIKDIVDPKKLGYWEHESTFKRAKYLRQKTYIQDIYMKEVKGYLVEGSPDDYTDIKFSVKCAGMTDKIKKEVTFENFKVGFSRKMKPKPVQVPGGVVLVDDTFTIKGHHHHHHHHHH

SEQ ID NO: 135 - protein, 627 aa, Artificial
  mutant recombinant phi29-type DNA polymerase
MSVDGLNDFFEAQKIEWHEAMGHHHHHHHHHHSSGHIEGRHMKHMPRKMYSCDFETTTKVEDCRVWAYGYMNIEDHSEYKIGNSLDEFMAWVLKVQADLYFHNLKFDGAFIINWLERNGFKWSADGLPNTYNTIISRMGQWYMIDICLGYKGKRKIHTVIYDSLKKLPFPVKKIAKDFKLTVLKGDIDIHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDINSAYPAQMYSRLLPYGEPIVFEGKYVWDEDYPLHIQHIRCEFELKEGYIPTIQIKRSRFYKGNEYLKSSGGEIADLWLSNVDLELMKEHYDLYNVEYISGLKFKATTGLFKDFIDKWTYIKTTSYGAIKQLAKLMLNSLYGKFASNPDVTGKVPYLKENGALGFRLGEEETKDPVYTPMGVFITAWARYTTITAAQACYDRIIYCDTDSIHLTGTEIPDVIKDIVDPKKLGYWEHESTFKRAKYLRQKTYIQDIYMKEVKGYLVEGSPDDYTDIKFSVKCAGMTDKIKKEVTFENFKVGFSRKMKPKPVQVPGGVVLVDDTFTIKGHHHHHHHHHH

SEQ ID NO: 136 - protein, 627 aa, Artificial
  mutant recombinant phi29-type DNA polymerase
MSVDGLNDFFEAQKIEWHEAMGHHHHHHHHHHSSGHIEGRHMKHMPRKMYSCDFETTTKVEDCRVWAYGYMNIEDHSEYKIGNSLDEFMAWVLKVQADLYFHNLKFDGAFIINWLERNGFKWSADGLPNTYNTIISRMGQWYMIDICLGYKGKRKIHTVIYDSLKKLPFPVKKIAKDFKLTVLKGDIDIHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDINSAYPAQMYSRLLPYGEPIVFEGKYVWDEDYPLHIQHIRCEFELKEGYIPTIQIKRSRFYKGNEYLKSSGGEIADLWLSNVDLELMKEHYDLYNVEYISGLKFKATTGLFKDFIDKWTYIKTTSYGAIKQLAKLMLNSLYGKFASNPDVTGKVPYLKENGALGFRLGEEETKDPVYTPMGVFITAWARYTTITAAQACYDRIIYCDTDSIHLTGTEIPDVIKDIVDPKKLGYWEHESTFKRAKYLRQKTYIQDIYMKEVKGYLVQGSPDDYTDIKFSVKCAGMTDKIKKEVTFENFKVGFSRKMKPKPVQVPGGVVLVDDTFTIKGHHHHHHHHHH

SEQ ID NO: 137 - protein, 627 aa, Artificial
  mutant recombinant phi29-type DNA polymerase
MSVDGLNDFFEAQKIEWHEAMGHHHHHHHHHHSSGHIEGRHMKHMPRKMYSCDFETTTKVEDCRVWAYGYMNIEDHSEYKIGNSLDEFMAWVLKVQADLYFHNLKFDGAFIINWLERNGFKWSADGLPNTYNTIISRMGQWYMIDICLGYKGKRKIHTVIYDSLKKLPFPVKKIAKDFKLTVLKGDIDYHKERPVGYKITPEEYAYIKNDIQIIAEALLIQFKQGLDRMTAGSDSLKGFKDIITTKKFKKVFPTLSLGLDKEVRYAYRGGFTWLNDRFKGKEIGEGMVFDVNSAYPAQMYSRLLPYGEPIVFEGKYVWDEDYPLHIQHIRCEFELKEGYIPTIQIKRSRFYKGNEYLKSSGGEIADLWLSNVDLELMKEHYDLYNVEYISGLKFKATTGLFKDFIDKWTYIKTTSYGAIKQLAKLMLNSLYGKFASNPDVTGKVPYLKENGALGFRLGEEETKDPVYTPMGVFITAWARYTTITAAQACYDRIIYCDTDSIHLTGTEIPDVIKDIVDPKKLGYWEHESTFKRAKYLRQKTYIQDIYMKEVKGYLVEGSPDDYTDIKFSVKCAGMTDKIKKEVTFENFKVGFSRKMKPKPVQVPGGVVLVDDTFTIKGHHHHHHHHHH

SEQ ID NO: 138 - protein, 627 aa, Artificial
  mutant recombinant phi29-type DNA polymerase
MSVDGLNDFFEAQKIEWHEAMGHHHHHHHHHHSSGHIEGRHMKHMPRKMYSCDFETTTKVEDCRVWAYGYMNIEDHSEYKIGNSLDEFMAWVLKVQADLYFHNLKFDGAFIINWLERNGFKWSADGLPNTYNTIISRMGQWYMIDICLGYKGKRKIHTVIYDSLKKLPFPVKKIAKDFKLTVLKGDIDYHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDVNSAYPAQMYSRLLPYGEPIVFEGKYVWDEDYPLHIQHIRCEFELKEGYIPTIQIKRSRFYKGNEYLKSSGGEIADLWLSNVDLELMKEHYDLYNVEYISGLKFKATTGLFKDFIDKWTYIKTTSYGAIKQLAKLMLNSLYGKFASNPDVTGKVPYLKENGALGFRLGEEETKDPVYTPMGVFITAWARYTTITAAQACYDRIIYCDTDSIHLTGTEIPDVIKDIVDPKKLGYWEHESTFKRAKYLRQKTYIQDIYMKEVKGYLVEGSPDDYTDIKFSVKCAGMTDKIKKEVTFENFKVGFSRKMKPKPVQVPGGVVLVDDTFTIKGHHHHHHHHHH

SEQ ID NO: 139 - protein, 627 aa, Artificial
  mutant recombinant phi29-type DNA polymerase
MSVDGLNDFFEAQKIEWHEAMGHHHHHHHHHHSSGHIEGRHMKHMPRKMYSCDFETTTKVEDCRVWAYGYMNIEDHSEYKIGNSLDEFMAWVLKVQADLYFHNLKFDGAFIINWLERNGFKWSADGLPNTYNTIISRMGQWYMIDICLGYKGKRKIHTVIYDSLKKLPFPVKKIAKDFKLTVLKGDIDIHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDVNSCYPAQMYSRLLPYGEPIVFEGKYVWDEDYPLHIQHIRCEFELKEGYIPTIQIKRSRFYKGNEYLKSSGGEIADLWLSNVDLELMKEHYDLYNVEYISGLKFKATTGLFKDFIDKWTYIKTTSYGAIKQLAKLMLNSLYGKFASNPDVTGKVPYLKENGALGFRLGEEETKDPVYTPMGVFITAWARYTTITAAQACYDRIIYCDTDSIHLTGTEIPDVIKDIVDPKKLGYWEHESTFKRAKYLRQKTYIQDIYMKEVKGYLVEGSPDDYTDIKFSVKCAGMTDKIKKEVTFENFKVGFSRKMKPKPVQVPGGVVLVDDTFTIKGHHHHHHHHHH

SEQ ID NO: 140 - protein, 616 aa, Artificial
  mutant recombinant phi29-type DNA polymerase
MSVDGLNDIFEAQKIEWHEAMGHHHHHHHHHHSSGHIEGRHMKHMPRKMYSCDFETTTKVEDCRVWAYGYMNIEDHSEYKIGNSLDEFMAWVLKVQADLYFHDLKFDGAFIINWLERNGFKWSADGLPNTYNTIISRMGQWYMIDICLGYKGKRKIHTVIYDSLKKLPFPVKKIAKDFKLTVLKGDIDYHKERPVGYKITPEEYAYIKNDIQIIAEALLIQFKQGLDRMTAGSDSLKGFKDIITTKKFKKVFPTLSLGLDKEVRYAYRGGFTWLNDRFKEKEIGEGMVFDINSAYPAQMYSRLLPYGEPIVFEGKYVWDEDYPLHIQHIRCEFELKEGYIPTIQIKRSRFYKGNEYLKSSGGEIADLWLSNVDLELMKEHYDLYNVEYISGLKFKATTGLFKDFIDKWTYIKTTSYGAIKQLAKLMLNSLYGKFASNPDVTGKVPYLKENGALGFRLGEEETKDPVYTPMGVFITAWARYTTITAAQACYDRIIYCDTDSIHLTGTEIPDVIKDIVDPKKLGYWEHESTFKRAKYLRQKTYIQDIYMKEVDGYLVEGSPDDYTDIKFSVKCAGMTDKIKKEVTFENFKVGFSRKMKPKPVQVPGGVVLVDDTFTIK

SEQ ID NO: 141 - protein, 627 aa, Artificial
  mutant recombinant phi29-type DNA polymerase
MSVDGLNDFFEAQKIEWHEAMGHHHHHHHHHHSSGHIEGRHMKHMPRKMYSCDFETTTKVEDCRVWAYGYMNIEDHSEYKIGNSLDEFMAWVLKVQADLYFHNLKFDGAFIINWLERNGFKWSADGLPNTYNTIISRMGQWYMIDICLGYKGKRKIHTVIYDSLKKLPFPVKKIAKDFKLTVLKGDIDYHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDVNSAYPAQMYSRLLPYGEPIVFEGKYVWDEDYPLHIQHIRCEFELKEGYIPTIQIKRSRFYKGNEYLKSSGGEIADLWLSNVDLELMKEHYDLYNVEYISGLKFKATTGLFKDFIDKWTYIKTTSYGAIKQLAKLMLNSLYGKFASNPDVTGKVPYLKENGALGFRLGEEETKDPVYTPMGVFITAWARYTTITAAQACYDRIIYCDTDSIHLTGTEIPDVIKDIVDPKKLGYWEHESTFKRAKYLRQKTYIQDIYMKEVDGYLVEGSPDDYTDIKLSVKCAGMTDKIKKEVTFENFKVGFSRKMKPKPVQVPGGVVLVDDTFTIKGHHHHHHHHHH

SEQ ID NO: 142 - protein, 627 aa, Artificial
  mutant recombinant phi29-type DNA polymerase
MSVDGLNDIFEAQKIEWHEAMGHHHHHHHHHHSSGHIEGRHMKHMPRKMYSCDFETTTKVEDCRVWAYGYMNIEDHSEYKIGNSLDEFMAWVLKVQADLYFHNLKFDGAFIINWLERNGFKWSADGLPNTYNTIISRMGQWYMIDICLGYKGKRKIHTVIYDSLKKLPFPVKKIAKDFKLTVLKGDIDYHKERPVGYKITPEEYAYIKNDIQIIAEALLIQFKQGLDRMTAGSDSLKGFKDIITTKKFKKVFPTLSLGLDKEVRYAYRGGFTWLNDRFKEKEIGEGMVFDVNSAYPAQMYSRLLPYGEPIVFEGKYVWDEDYPLHIQHIRCEFELKEGYIPTIQIKRSRFYKGNEYLKSSGGEIADLWLSNVDLELMKEHYDLYNVEYISGLKFKATTGLFKDFIDKWTYIKTTSYGAIKQLAKLMLNSLYGKFASNPDVTGKVPYLKENGALGFRLGEEETKDPVYTPMGVFITAWARYTTITAAQACYDRIIYCDTDSIHLTGTEIPDVIKDIVDPKKLGYWEHESTFKRAKYLRQKTYIQDIYMKEVDGYLVKGSPDDYTDIKFSVKCAGMTDKIKKEVTFENFKVGFSRKMKPKPVQVPGGVVLVDDTFTIKGHHHHHHHHHH

SEQ ID NO: 143 - protein, 627 aa, Artificial
  mutant recombinant phi29-type DNA polymerase
MSVDGLNDFFEAQKIEWHEAMGHHHHHHHHHHSSGHIEGRHMKHMPRKMYSCDFETTTKVEDCRVWAYGYMNIEDHSEYKIGNSLDEFMAWVLKVQADLYFHNLKFDGAFIINWLERNGFKWSADGLPNTYNTIISRMGQWYMIDICLGYKGKRKIHTVIYDSLKKLPFPVKKIAKDFKLTVLKGDIDYHKERPVGYKITPEEYAYIKNDIQIIAEALLIQFKQGLDRMTAGSDSLKGFKDIITTKKFKKVFPTLSLGLDKEVRYAYRGGFTWLNDRFKGKEIGEGMVFDVNSAYPAQMYSRLLPYGEPIVFEGKYVWDEDYPLHIQHIRCEFELKEGYIPTIQIKRSRFYKGNEYLKSSGGEIADLWLSNVDLELMKEHYDLYNVEYISGLKFKATTGLFKDFIDKWTYIKTTSYGAIKQLAKLMLNSLYGKFASNPDVTGKVPYLKENGALGFRLGEEETKDPVYTPMGVFITAWARYTTITAAQACYDRIIYCDTDSIHLTGTEIPDVIKDIVDPKKLGYWEHESTFKRAKYLRQKTYIQDIYMKRVDGYLVEGSPDDYTDIKFSVKCAGMTDKIKKEVTFENFKVGFSRKMKPKPVQVPGGVVLVDDTFTIKGHHHHHHHHHH

SEQ ID NO: 144 - protein, 627 aa, Artificial
  mutant recombinant phi29-type DNA polymerase
MSVDGLNDIFEAQKIEWHEAMGHHHHHHHHHHSSGHIEGRHMKHMPRKMYSCDFETTTKVEDCRVWAYGYMNIEDHSEYKIGNSLDEFMAWVLKVQADLYFHNLKFDGAFIINWLERNGFKWSADGLPNTYNTIISRMGQWYMIDICLGYKGKRKIHTVIYDSLKKLPFPVKKIAKDFKLTVLKGDIDIHKERPVGYKITPEEYAYIKNDIQIIAEALLIQFKQGLDRMTAGSDSLKGFKDIITTKKFKKVFPTLSLGLDKEVRYAYRGGFTWLNDRFKEKEIGEGMVFDVNSAYPAQMYSRLLPYGEPIVFEGKYVWDEDYPLHIQHIRCEFELKEGYIPTIQIKRSRFYKGNEYLKSSGGEIADLWLSNVDLELMKEHYDLYNVEYISGLKFKATTGLFKDFIDKWTYIKTTSYGAIKQLAKLMLNSLYGKFASNPDVTGKVPYLKENGALGFRLGEEETKDPVYTPMGVFITAWARYTTITAAQACYDRIIYCDTDSIHLTGTEIPDVIKDIVDPKKLGYWEHESTFKRAKYLRQKTYIQDIYMKEVDGYLVEGSPDDYTDIKFSVKCAGMTDKIKKEVTFENFKVGFSRKMKPKPVQVPGGVVLVDDTFTIKGHHHHHHHHHH

SEQ ID NO: 145 - protein, 627 aa, Artificial
  mutant recombinant phi29-type DNA polymerase
MSVDGLNDFFEAQKIEWHEAMGHHHHHHHHHHSSGHIEGRHMKHMPRKMYSCDFETTTKVEDCRVWAYGYMNIEDHSEYKIGNSLDEFMAWVLKVQADLYFHNLKFRGAFIINWLERNGFKWSADGLPNTYNTIISRMGQWYMIDICLGYKGKRKIHTVIYDSLKKLPFPVKKIAKDFKLTVLKGDIDIHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDINSAYPAQMYSRLLPYGEPIVFEGKYVWDEDYPLHIQHIRCEFELKEGYIPTIQIKRSRFYKGNEYLKSSGGEIADLWLSNVDLELMKEHYDLYNVEYISGLKFKATTGLFKDFIDKWTYIKTTSYGAIKQLAKLMLNSLYGKFASNPDVTGKVPYLKENGALGFRLGEEETKDPVYTPMGVFITAWARYTTITAAQACYDRIIYCDTDSIHLTGTEIPDVIKDIVDPKKLGYWEHESTFKRAKYLRQKTYIQDIYMKEVKGYLVEGSPDDYTDIKFSVKCAGMTDKIKKEVTFENFKVGFSRKMKPKPVQVPGGVVLVDDTFTIKGHHHHHHHHHH

SEQ ID NO: 146 - protein, 627 aa, Artificial
  mutant recombinant phi29-type DNA polymerase
MSVDGLNDFFEAQKIEWHEAMGHHHHHHHHHHSSGHIEGRHMKHMPRKMYSCDFETTTKVEDCRVWAYGYMNIEDHSEYKIGNSLDEFMAWVLKVQADLYFHDLKFDGAFIINWLERNGFKWSADGLPNTYNTIISRMGQWYMIDICLGYKGKRKIHTVIYDSLKKLPFPVKKIAKDFKLTVLKGDIDIHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDINSAYPAQMYSRLLPYGEPIVFEGKYVWDEDYPLHIQHIRCEFELKEGYIPTIQIKRSRFYKGNEYLKSSGGEIADLWLSNVDLELMKEHYDLYNVEYISGLKFKATTGLFKDFIDKWTYIKTTSYGAIKQLAKLMLNSLYGKFASNPDVTGKVPYLKENGALGFRLGEEETKDPVYTPMGVFITAWARYTTITAAQACYDRIIYCDTDSIHLTGTEIPDVIKDIVDPKKLGYWEHESTFKRAKYLRQKTYIQDIYMKEVKGYLVEGSPDDYTDIKFSVKCAGMTDKIKKEVTFENFKVGFSRKMKPKPVQVPGGVVLVDDTFTIKGHHHHHHHHHH

SEQ ID NO: 147 - protein, 627 aa, Artificial
  mutant recombinant phi29-type DNA polymerase
MSVDGLNDFFEAQKIEWHEAMGHHHHHHHHHHSSGHIEGRHMKHMPRKMYSCDFETTTKVEDCRVWAYGYMNIEDHSEYKIGNSLDEFMAWVLKVQADLYFHNLKFDGAFIINWLERNGFKWSADGLPNTYNTIISRMGQWYMIDICLGYKGKRKIHTVIYDSLKKLPFPVKKIAKDFKLTVLRGDIDIHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDINSAYPAQMYSRLLPYGEPIVFEGKYVWDEDYPLHIQHIRCEFELKEGYIPTIQIKRSRFYKGNEYLKSSGGEIADLWLSNVDLELMKEHYDLYNVEYISGLKFKATTGLFKDFIDKWTYIKTTSYGAIKQLAKLMLNSLYGKFASNPDVTGKVPYLKENGALGFRLGEEETKDPVYTPMGVFITAWARYTTITAAQACYDRIIYCDTDSIHLTGTEIPDVIKDIVDPKKLGYWEHESTFKRAKYLRQKTYIQDIYMKEVKGYLVEGSPDDYTDIKFSVKCAGMTDKIKKEVTFENFKVGFSRKMKPKPVQVPGGVVLVDDTFTIKGHHHHHHHHHH

SEQ ID NO: 148 - protein, 627 aa, Artificial
  mutant recombinant phi29-type DNA polymerase
MSVDGLNDFFEAQKIEWHEAMGHHHHHHHHHHSSGHIEGRHMKHMPRKMYSCNFETTTKVEDCRVWAYGYMNIEDHSEYKIGNSLDEFMAWVLKVQADLYFHNLKFDGAFIINWLERNGFKWSADGLPNTYNTIISRMGQWYMIDICLGYKGKRKIHTVIYDSLKKLPFPVKKIAKDFKLTVLKGDIDYHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDVNSAYPAQMYSRLLPYGEPIVFEGKYVWDEDYPLHIQHIRCEFELKEGYIPTIQIKRSRFYKGNEYLKSSGGEIADLWLSNVDLELMKEHYDLYNVEYISGLKFKATTGLFKDFIDKWTYIKTTSYGAIKQLAKLMLNSLYGKFASNPDVTGKVPYLKENGALGFRLGEEETKDPVYTPMGVFITAWARYTTITAAQACYDRIIYCDTDSIHLTGTEIPDVIKDIVDPKKLGYWEHESTFKRAKYLRQKTYIQDIYMKEVDGYLVEGSPDDYTDIKFSVKCAGMTDKIKKEVTFENFKVGFSRKMKPKPVQVPGGVVLVDDTFTIKGHHHHHHHHHH

SEQ ID NO: 149 - protein, 627 aa, Artificial
  mutant recombinant phi29-type DNA polymerase
MSVDGLNDFFEAQKIEWHEAMGHHHHHHHHHHSSGHIEGRHMKHMPRKMYSCDFETTTKVEDCRVWAYGYMNIEDHSEYKIGNSLDEFMAWVLKVQADLYFHNLKFDGAFIINWLERNGFKWSADGLPNTYNTIISRMGQWYMIDICLGYKGKRKIHTVIYDSLKKLPFPVKKIAKDFKLTVLKGDIDFHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDINSAYPAQMYSRLLPYGEPIVFEGKYVWDEDYPLHIQHIRCEFELKEGYIPTIQIKRSRFYKGNEYLKSSGGEIADLWLSNVDLELMKEHYDLYNVEYISGLKFKATTGLFKDFIDKWTYIKTTSYGAIKQLAKLMLNSLYGKFASNPDVTGKVPYLKENGALGFRLGEEETKDPVYTPMGVFITAWARYTTITAAQACYDRIIYCDTDSIHLTGTEIPDVIKDIVDPKKLGYWEHESTFKRAKYLRQKTYIQDIYMKEVKGYLVEGSPDDYTDIKFSVKCAGMTDKIKKEVTFENFKVGFSRKMKPKPVQVPGGVVLVDDTFTIKGHHHHHHHHHH

SEQ ID NO: 150 - protein, 627 aa, Artificial
  mutant recombinant phi29-type DNA polymerase
MSVDGLNDFFEAQKIEWHEAMGHHHHHHHHHHSSGHIEGRHMKHMPRKMYSCDFETTTKVEDCRVWAYGYMNIEDHSEYKIGNSLDEFMAWVLKVQADLYFHNLKFDGAFIINWLERNGFKWSADGLPNTYNTIISRMGQWYMIDICLGYKGKRKIHTVIYDSLKKLPFPVKKIAKDFKLTVLKGDIDIHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDINSAYPAQMYSRLLPYGEPIVFEGKYVWDEDYPLHIQHIRCEFELKEGYIPTIQIKRSRFYKGNEYLKSSGGEIADLWLSNVDLELMKEHYDLYNVEYISGLKFKATTGLFKDFIDKWTYIKTTSYGAIKQLAKLMLNSLYGKFASNPDVTGKVPYLKENGALGFRLGEEETKDPVYTPMGVFITAWARYTTITAAQACYDRIIYCDTDSIHLTGTEIPDVIKDIVDPKKLGYWEHESTFKRAKYLRQKTYIQDIYMKEVRGYLVEGSPDDYTDIKFSVKCAGMTDKIKKEVTFENFKVGFSRKMKPKPVQVPGGVVLVDDTFTIKGHHHHHHHHHH

SEQ ID NO: 151 - protein, 627 aa, Artificial
  mutant recombinant phi29-type DNA polymerase
MSVDGLNDFFEAQKIEWHEAMGHHHHHHHHHHSSGHIEGRHMKHMPRKMYSCDFETTTKVEDCRVWAYGYMNIEDHSEYKIGNSLDEFMAWVLKVQADLYFHNLKFDGAFIINWLERNGFKWSADGLPNTYNTIISRMGQWYMIDICLGYKGKRKIHTVIYDSLKKLPFPVKKIAKDFKLTVLKGDIDIHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDINSAYPAQMYSRLLPYGEPIVFEGKYVWDEDYPLHIQHIRCEFELKEGYIPTIQIKRSRFYKGNEYLKSSGGEIADLWLSNVDLELMKEHYDLYNVEYISGLKFKATTGLFKDFIDKWTYIKTTSYGAIKQLAKLMLNSLYGKFASNPDVTGKVPYLKENGALGFRLGEEETKDPVYTPMGVFITAWARYTTITAAQACYDRIIYCDTDSIHLTGTEIPDVIKDIVDPKKLGYWEHESTFKRAKYLRQKTYIQDIYMKEVHGYLVEGSPDDYTDIKFSVKCAGMTDKIKKEVTFENFKVGFSRKMKPKPVQVPGGVVLVDDTFTIKGHHHHHHHHHH

SEQ ID NO: 152 - protein, 627 aa, Artificial
  mutant recombinant phi29-type DNA polymerase
MSVDGLNDFFEAQKIEWHEAMGHHHHHHHHHHSSGHIEGRHMKHMPRKMYSCDFETTTKVEDCRVWAYGYMNIEDHSEYKIGNSLDEFMAWVLKVQADLYFHNLKFDGAFIINWLERNGFKWSADGLPNTYNTIISRMGQWYMIDICLGYKGKRKIHTVIYDSLKKLPFPVKKIAKDFKLTVLKGDIDIHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDINSAYPAQMYSRLLPYGEPIVFEGKYVWDEDYPLHIQHIRCEFELKEGYIPTIQIKRSRFYKGNEYLKSSGGEIADLWLSNVDLELMKEHYDLYNVEYISGLKFKATTGLFKDFIDKWTYIKTTSYGAIKQLAKLMLNSLYGKFASNPDVTGKVPYLKENGALGFRLGEEETKDPVYTPMGVFITAWARYTTITAAQACYDRIIYCDTDSIHLTGTEIPDVIKDIVDPKKLGYWEHESTFKRAKYLRQKTYIQDIYMKKVKGYLVEGSPDDYTDIKFSVKCAGMTDKIKKEVTFENFKVGFSRKMKPKPVQVPGGVVLVDDTFTIKGHHHHHHHHHH

SEQ ID NO: 153 - protein, 586 aa, Artificial
  mutant recombinant phi29-type DNA polymerase
MKHMPRKMYSCDFETTTKVEDCRVWAYGYMNIEDHSEYKIGNSLDEFMAWVLKVQADLYFHNLKFDGAFIINWLERNGFKWSADGLPNTYNTIISRMGQWYMIDICLGYKGKRKIHTVIYDSLKKLPFPVKKIAKDFKLTVLKGDIDYHKERPVGYKITPEEYAYIKNDIQIIAEALLIQFKQGLDRMTAGSDSLKGFKDIITTKKFKKVFPTLSLGLDKEVRYAYRGGFTWLNDRFKEKEIGEGMVFDVNSAYPAQMYSRLLPYGEPIVFEGKYVWDEDYPLHIQHIRCEFELKEGYIPTIQIKRSRFYKGNEYLKSSGGEIADLWLSNVDLELMKEHYDLYNVEYISGLKFKATTGLFKDFIDKWTYIKTTSYGAIKQLAKLMLNSLYGKFASNPDVTGKVPYLKENGALGFRLGEEETKDPVYTPMGVFITAWARYTTITAAQACYDRIIYCDTDSIHLTGTEIPDVIKDIVDPKKLGYWEHESTFKRAKYLRQKTYIQDIYMKEVDGYLVEGSPDDYTDIKFSVKCAGMTDKIKKEVTFENFKVGFSRKMKPKPVQVPGGVVLVDDTFTIKGHHHHHHHHHH

SEQ ID NO: 154 - protein, 586 aa, Artificial
  mutant recombinant phi29-type DNA polymerase
MKHMPRKMYSCDFETTTKVEDCRVWAYGYMNIEDHSEYKIGNSLDEFMAWVLKVQADLYFHNLKFDGAFIINWLERNGFKWSADGLPNTYNTIISRMGQWYMIDICLGYKGKRKIHTVIYDSLKKLPFPVKKIAKDFKLTVLKGDIDYHKERPVGYKITPEEYAYIKNDIQIIAEALLIQFKQGLDRMTAGSDSLKGFKDIITTKKFKKVFPTLSLGLDKEVRYAYRGGFTWLNDRFKEKEIGEGMVFDVNSAYPAQMYSRLLPYGEPIVFEGKYVWDEDYPLHIQHIRCEFELKEGYIPTIQIKRSRFYKGNEYLKSSGGEIADLWLSNVDLELMKEHYDLYNVEYISGLKFKATTGLFKDFIDKWTYIKTTSYGAIKQLAKLMLNSLYGKFASNPDVTGKVPYLKENGALGFRLGEEETKDPVYTPMGVFITAWARYTTITAAQACYDRIIYCDTDSIHLTGTEIPDVIKDIVDPKKLGYWEHESTFKRAKYLRQKTYIQDIYMKEVKGYLVEGSPDDYTDIKFSVKCAGMTDKIKKEVTFENFKVGFSRKMKPKPVQVPGGVVLVDDTFTIKGHHHHHHHHHH

SEQ ID NO: 155 - protein, 586 aa, Artificial
  mutant recombinant phi29-type DNA polymerase
MKHMPRKMYSCDFETTTKVEDCRVWAYGYMNIEDHSEYKIGNSLDEFMAWVLKVQADLYFHNLKFDGAFIINWLERNGFKWSADGLPNTYNTIISRMGQWYMIDICLGYKGKRKIHTVIYDSLKKLPFPVKKIAKDFKLTVLKGDIDIHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDINSAYPAQMYSRLLPYGEPIVFEGKYVWDEDYPLHIQHIRCEFELKEGYIPTIQIKRSRFYKGNEYLKSSGGEIADLWLSNVDLELMKEHYDLYNVEYISGLKFKATTGLFKDFIDKWTYIKTTSYGAIKQLAKLMLNSLYGKFASNPDVTGKVPYLKENGALGFRLGEEETKDPVYTPMGVFITAWARYTTITAAQACYDRIIYCDTDSIHLTGTEIPDVIKDIVDPKKLGYWEHESTFKRAKYLRQKTYIQDIYMKEVKGYLVEGSPDDYTDIKFSVKCAGMTDKIKKEVTFENFKVGFSRKMKPKPVQVPGGVVLVDDTFTIKGHHHHHHHHHH

SEQ ID NO: 156 - protein, 586 aa, Artificial
  mutant recombinant phi29-type DNA polymerase
MKHMPRKMYSCDFETTTKVEDCRVWAYGYMNIEDHSEYKIGNSLDEFMAWVLKVQADLYFHNLKFDGAFIINWLERNGFKWSADGLPNTYNTIISRMGQWYMIDICLGYKGKRKIHTVIYDSLKKLPFPVKKIAKDFKLTVLKGDIDIHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDINSAYPAQMYSRLLPYGEPIVFEGKYVWDEDYPLHIQHIRCEFELKEGYIPTIQIKRSRFYKGNEYLKSSGGEIADLWLSNVDLELMKEHYDLYNVEYISGLKFKATTGLFKDFIDKWTYIKTTSYGAIKQLAKLMLNSLYGKFASNPDVTGKVPYLKENGALGFRLGEEETKDPVYTPMGVFITAWARYTTITAAQACYDRIIYCDTDSIHLTGTEIPDVIKDIVDPKKLGYWEHESTFKRAKYLRQKTYIQDIYMKEVKGYLVQGSPDDYTDIKFSVKCAGMTDKIKKEVTFENFKVGFSRKMKPKPVQVPGGVVLVDDTFTIKGHHHHHHHHHH

SEQ ID NO: 157 - protein, 586 aa, Artificial
  mutant recombinant phi29-type DNA polymerase
MKHMPRKMYSCDFETTTKVEDCRVWAYGYMNIEDHSEYKIGNSLDEFMAWVLKVQADLYFHNLKFDGAFIINWLERNGFKWSADGLPNTYNTIISRMGQWYMIDICLGYKGKRKIHTVIYDSLKKLPFPVKKIAKDFKLTVLKGDIDYHKERPVGYKITPEEYAYIKNDIQIIAEALLIQFKQGLDRMTAGSDSLKGFKDIITTKKFKKVFPTLSLGLDKEVRYAYRGGFTWLNDRFKGKEIGEGMVFDVNSAYPAQMYSRLLPYGEPIVFEGKYVWDEDYPLHIQHIRCEFELKEGYIPTIQIKRSRFYKGNEYLKSSGGEIADLWLSNVDLELMKEHYDLYNVEYISGLKFKATTGLFKDFIDKWTYIKTTSYGAIKQLAKLMLNSLYGKFASNPDVTGKVPYLKENGALGFRLGEEETKDPVYTPMGVFITAWARYTTITAAQACYDRIIYCDTDSIHLTGTEIPDVIKDIVDPKKLGYWEHESTFKRAKYLRQKTYIQDIYMKEVKGYLVEGSPDDYTDIKFSVKCAGMTDKIKKEVTFENFKVGFSRKMKPKPVQVPGGVVLVDDTFTIKGHHHHHHHHHH

SEQ ID NO: 158 - protein, 586 aa, Artificial
  mutant recombinant phi29-type DNA polymerase
MKHMPRKMYSCDFETTTKVEDCRVWAYGYMNIEDHSEYKIGNSLDEFMAWVLKVQADLYFHNLKFDGAFIINWLERNGFKWSADGLPNTYNTIISRMGQWYMIDICLGYKGKRKIHTVIYDSLKKLPFPVKKIAKDFKLTVLKGDIDYHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDVNSAYPAQMYSRLLPYGEPIVFEGKYVWDEDYPLHIQHIRCEFELKEGYIPTIQIKRSRFYKGNEYLKSSGGEIADLWLSNVDLELMKEHYDLYNVEYISGLKFKATTGLFKDFIDKWTYIKTTSYGAIKQLAKLMLNSLYGKFASNPDVTGKVPYLKENGALGFRLGEEETKDPVYTPMGVFITAWARYTTITAAQACYDRIIYCDTDSIHLTGTEIPDVIKDIVDPKKLGYWEHESTFKRAKYLRQKTYIQDIYMKEVKGYLVEGSPDDYTDIKFSVKCAGMTDKIKKEVTFENFKVGFSRKMKPKPVQVPGGVVLVDDTFTIKGHHHHHHHHHH

SEQ ID NO: 159 - protein, 586 aa, Artificial
  mutant recombinant phi29-type DNA polymerase
MKHMPRKMYSCDFETTTKVEDCRVWAYGYMNIEDHSEYKIGNSLDEFMAWVLKVQADLYFHNLKFDGAFIINWLERNGFKWSADGLPNTYNTIISRMGQWYMIDICLGYKGKRKIHTVIYDSLKKLPFPVKKIAKDFKLTVLKGDIDIHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDVNSCYPAQMYSRLLPYGEPIVFEGKYVWDEDYPLHIQHIRCEFELKEGYIPTIQIKRSRFYKGNEYLKSSGGEIADLWLSNVDLELMKEHYDLYNVEYISGLKFKATTGLFKDFIDKWTYIKTTSYGAIKQLAKLMLNSLYGKFASNPDVTGKVPYLKENGALGFRLGEEETKDPVYTPMGVFITAWARYTTITAAQACYDRIIYCDTDSIHLTGTEIPDVIKDIVDPKKLGYWEHESTFKRAKYLRQKTYIQDIYMKEVKGYLVEGSPDDYTDIKFSVKCAGMTDKIKKEVTFENFKVGFSRKMKPKPVQVPGGVVLVDDTFTIKGHHHHHHHHHH

SEQ ID NO: 160 - protein, 586 aa, Artificial
  mutant recombinant phi29-type DNA polymerase
MKHMPRKMYSCDFETTTKVEDCRVWAYGYMNIEDHSEYKIGNSLDEFMAWVLKVQADLYFHNLKFDGAFIINWLERNGFKWSADGLPNTYNTIISRMGQWYMIDICLGYKGKRKIHTVIYDSLKKLPFPVKKIAKDFKLTVLKGDIDYHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDVNSAYPAQMYSRLLPYGEPIVFEGKYVWDEDYPLHIQHIRCEFELKEGYIPTIQIKRSRFYKGNEYLKSSGGEIADLWLSNVDLELMKEHYDLYNVEYISGLKFKATTGLFKDFIDKWTYIKTTSYGAIKQLAKLMLNSLYGKFASNPDVTGKVPYLKENGALGFRLGEEETKDPVYTPMGVFITAWARYTTITAAQACYDRIIYCDTDSIHLTGTEIPDVIKDIVDPKKLGYWEHESTFKRAKYLRQKTYIQDIYMKEVDGYLVEGSPDDYTDIKLSVKCAGMTDKIKKEVTFENFKVGFSRKMKPKPVQVPGGVVLVDDTFTIKGHHHHHHHHHH

SEQ ID NO: 161 - protein, 586 aa, Artificial
  mutant recombinant phi29-type DNA polymerase
MKHMPRKMYSCDFETTTKVEDCRVWAYGYMNIEDHSEYKIGNSLDEFMAWVLKVQADLYFHNLKFDGAFIINWLERNGFKWSADGLPNTYNTIISRMGQWYMIDICLGYKGKRKIHTVIYDSLKKLPFPVKKIAKDFKLTVLKGDIDYHKERPVGYKITPEEYAYIKNDIQIIAEALLIQFKQGLDRMTAGSDSLKGFKDIITTKKFKKVFPTLSLGLDKEVRYAYRGGFTWLNDRFKEKEIGEGMVFDVNSAYPAQMYSRLLPYGEPIVFEGKYVWDEDYPLHIQHIRCEFELKEGYIPTIQIKRSRFYKGNEYLKSSGGEIADLWLSNVDLELMKEHYDLYNVEYISGLKFKATTGLFKDFIDKWTYIKTTSYGAIKQLAKLMLNSLYGKFASNPDVTGKVPYLKENGALGFRLGEEETKDPVYTPMGVFITAWARYTTITAAQACYDRIIYCDTDSIHLTGTEIPDVIKDIVDPKKLGYWEHESTFKRAKYLRQKTYIQDIYMKEVDGYLVKGSPDDYTDIKFSVKCAGMTDKIKKEVTFENFKVGFSRKMKPKPVQVPGGVVLVDDTFTIKGHHHHHHHHHH

SEQ ID NO: 162 - protein, 586 aa, Artificial
  mutant recombinant phi29-type DNA polymerase
MKHMPRKMYSCDFETTTKVEDCRVWAYGYMNIEDHSEYKIGNSLDEFMAWVLKVQADLYFHNLKFDGAFIINWLERNGFKWSADGLPNTYNTIISRMGQWYMIDICLGYKGKRKIHTVIYDSLKKLPFPVKKIAKDFKLTVLKGDIDYHKERPVGYKITPEEYAYIKNDIQIIAEALLIQFKQGLDRMTAGSDSLKGFKDIITTKKFKKVFPTLSLGLDKEVRYAYRGGFTWLNDRFKGKEIGEGMVFDVNSAYPAQMYSRLLPYGEPIVFEGKYVWDEDYPLHIQHIRCEFELKEGYIPTIQIKRSRFYKGNEYLKSSGGEIADLWLSNVDLELMKEHYDLYNVEYISGLKFKATTGLFKDFIDKWTYIKTTSYGAIKQLAKLMLNSLYGKFASNPDVTGKVPYLKENGALGFRLGEEETKDPVYTPMGVFITAWARYTTITAAQACYDRIIYCDTDSIHLTGTEIPDVIKDIVDPKKLGYWEHESTFKRAKYLRQKTYIQDIYMKRVDGYLVEGSPDDYTDIKFSVKCAGMTDKIKKEVTFENFKVGFSRKMKPKPVQVPGGVVLVDDTFTIKGHHHHHHHHHH

SEQ ID NO: 163 - protein, 586 aa, Artificial
  mutant recombinant phi29-type DNA polymerase
MKHMPRKMYSCDFETTTKVEDCRVWAYGYMNIEDHSEYKIGNSLDEFMAWVLKVQADLYFHNLKFDGAFIINWLERNGFKWSADGLPNTYNTIISRMGQWYMIDICLGYKGKRKIHTVIYDSLKKLPFPVKKIAKDFKLTVLKGDIDIHKERPVGYKITPEEYAYIKNDIQIIAEALLIQFKQGLDRMTAGSDSLKGFKDIITTKKFKKVFPTLSLGLDKEVRYAYRGGFTWLNDRFKEKEIGEGMVFDVNSAYPAQMYSRLLPYGEPIVFEGKYVWDEDYPLHIQHIRCEFELKEGYIPTIQIKRSRFYKGNEYLKSSGGEIADLWLSNVDLELMKEHYDLYNVEYISGLKFKATTGLFKDFIDKWTYIKTTSYGAIKQLAKLMLNSLYGKFASNPDVTGKVPYLKENGALGFRLGEEETKDPVYTPMGVFITAWARYTTITAAQACYDRIIYCDTDSIHLTGTEIPDVIKDIVDPKKLGYWEHESTFKRAKYLRQKTYIQDIYMKEVDGYLVEGSPDDYTDIKFSVKCAGMTDKIKKEVTFENFKVGFSRKMKPKPVQVPGGVVLVDDTFTIKGHHHHHHHHHH

SEQ ID NO: 164 - protein, 586 aa, Artificial
  mutant recombinant phi29-type DNA polymerase
MKHMPRKMYSCDFETTTKVEDCRVWAYGYMNIEDHSEYKIGNSLDEFMAWVLKVQADLYFHNLKFRGAFIINWLERNGFKWSADGLPNTYNTIISRMGQWYMIDICLGYKGKRKIHTVIYDSLKKLPFPVKKIAKDFKLTVLKGDIDIHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDINSAYPAQMYSRLLPYGEPIVFEGKYVWDEDYPLHIQHIRCEFELKEGYIPTIQIKRSRFYKGNEYLKSSGGEIADLWLSNVDLELMKEHYDLYNVEYISGLKFKATTGLFKDFIDKWTYIKTTSYGAIKQLAKLMLNSLYGKFASNPDVTGKVPYLKENGALGFRLGEEETKDPVYTPMGVFITAWARYTTITAAQACYDRIIYCDTDSIHLTGTEIPDVIKDIVDPKKLGYWEHESTFKRAKYLRQKTYIQDIYMKEVKGYLVEGSPDDYTDIKFSVKCAGMTDKIKKEVTFENFKVGFSRKMKPKPVQVPGGVVLVDDTFTIKGHHHHHHHHHH

SEQ ID NO: 165 - protein, 586 aa, Artificial
  mutant recombinant phi29-type DNA polymerase
MKHMPRKMYSCDFETTTKVEDCRVWAYGYMNIEDHSEYKIGNSLDEFMAWVLKVQADLYFHDLKFDGAFIINWLERNGFKWSADGLPNTYNTIISRMGQWYMIDICLGYKGKRKIHTVIYDSLKKLPFPVKKIAKDFKLTVLKGDIDIHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDINSAYPAQMYSRLLPYGEPIVFEGKYVWDEDYPLHIQHIRCEFELKEGYIPTIQIKRSRFYKGNEYLKSSGGEIADLWLSNVDLELMKEHYDLYNVEYISGLKFKATTGLFKDFIDKWTYIKTTSYGAIKQLAKLMLNSLYGKFASNPDVTGKVPYLKENGALGFRLGEEETKDPVYTPMGVFITAWARYTTITAAQACYDRIIYCDTDSIHLTGTEIPDVIKDIVDPKKLGYWEHESTFKRAKYLRQKTYIQDIYMKEVKGYLVEGSPDDYTDIKFSVKCAGMTDKIKKEVTFENFKVGFSRKMKPKPVQVPGGVVLVDDTFTIKGHHHHHHHHHH

SEQ ID NO: 166 - protein, 586 aa, Artificial
  mutant recombinant phi29-type DNA polymerase
MKHMPRKMYSCDFETTTKVEDCRVWAYGYMNIEDHSEYKIGNSLDEFMAWVLKVQADLYFHNLKFDGAFIINWLERNGFKWSADGLPNTYNTIISRMGQWYMIDICLGYKGKRKIHTVIYDSLKKLPFPVKKIAKDFKLTVLRGDIDIHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDINSAYPAQMYSRLLPYGEPIVFEGKYVWDEDYPLHIQHIRCEFELKEGYIPTIQIKRSRFYKGNEYLKSSGGEIADLWLSNVDLELMKEHYDLYNVEYISGLKFKATTGLFKDFIDKWTYIKTTSYGAIKQLAKLMLNSLYGKFASNPDVTGKVPYLKENGALGFRLGEEETKDPVYTPMGVFITAWARYTTITAAQACYDRIIYCDTDSIHLTGTEIPDVIKDIVDPKKLGYWEHESTFKRAKYLRQKTYIQDIYMKEVKGYLVEGSPDDYTDIKFSVKCAGMTDKIKKEVTFENFKVGFSRKMKPKPVQVPGGVVLVDDTFTIKGHHHHHHHHHH

SEQ ID NO: 167 - protein, 586 aa, Artificial
  mutant recombinant phi29-type DNA polymerase
MKHMPRKMYSCNFETTTKVEDCRVWAYGYMNIEDHSEYKIGNSLDEFMAWVLKVQADLYFHNLKFDGAFIINWLERNGFKWSADGLPNTYNTIISRMGQWYMIDICLGYKGKRKIHTVIYDSLKKLPFPVKKIAKDFKLTVLKGDIDYHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDVNSAYPAQMYSRLLPYGEPIVFEGKYVWDEDYPLHIQHIRCEFELKEGYIPTIQIKRSRFYKGNEYLKSSGGEIADLWLSNVDLELMKEHYDLYNVEYISGLKFKATTGLFKDFIDKWTYIKTTSYGAIKQLAKLMLNSLYGKFASNPDVTGKVPYLKENGALGFRLGEEETKDPVYTPMGVFITAWARYTTITAAQACYDRIIYCDTDSIHLTGTEIPDVIKDIVDPKKLGYWEHESTFKRAKYLRQKTYIQDIYMKEVDGYLVEGSPDDYTDIKFSVKCAGMTDKIKKEVTFENFKVGFSRKMKPKPVQVPGGVVLVDDTFTIKGHHHHHHHHHH

SEQ ID NO: 168 - protein, 586 aa, Artificial
  mutant recombinant phi29-type DNA polymerase
MKHMPRKMYSCDFETTTKVEDCRVWAYGYMNIEDHSEYKIGNSLDEFMAWVLKVQADLYFHNLKFDGAFIINWLERNGFKWSADGLPNTYNTIISRMGQWYMIDICLGYKGKRKIHTVIYDSLKKLPFPVKKIAKDFKLTVLKGDIDFHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDINSAYPAQMYSRLLPYGEPIVFEGKYVWDEDYPLHIQHIRCEFELKEGYIPTIQIKRSRFYKGNEYLKSSGGEIADLWLSNVDLELMKEHYDLYNVEYISGLKFKATTGLFKDFIDKWTYIKTTSYGAIKQLAKLMLNSLYGKFASNPDVTGKVPYLKENGALGFRLGEEETKDPVYTPMGVFITAWARYTTITAAQACYDRIIYCDTDSIHLTGTEIPDVIKDIVDPKKLGYWEHESTFKRAKYLRQKTYIQDIYMKEVKGYLVEGSPDDYTDIKFSVKCAGMTDKIKKEVTFENFKVGFSRKMKPKPVQVPGGVVLVDDTFTIKGHHHHHHHHHH

SEQ ID NO: 169 - protein, 586 aa, Artificial
  mutant recombinant phi29-type DNA polymerase
MKHMPRKMYSCDFETTTKVEDCRVWAYGYMNIEDHSEYKIGNSLDEFMAWVLKVQADLYFHNLKFDGAFIINWLERNGFKWSADGLPNTYNTIISRMGQWYMIDICLGYKGKRKIHTVIYDSLKKLPFPVKKIAKDFKLTVLKGDIDIHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDINSAYPAQMYSRLLPYGEPIVFEGKYVWDEDYPLHIQHIRCEFELKEGYIPTIQIKRSRFYKGNEYLKSSGGEIADLWLSNVDLELMKEHYDLYNVEYISGLKFKATTGLFKDFIDKWTYIKTTSYGAIKQLAKLMLNSLYGKFASNPDVTGKVPYLKENGALGFRLGEEETKDPVYTPMGVFITAWARYTTITAAQACYDRIIYCDTDSIHLTGTEIPDVIKDIVDPKKLGYWEHESTFKRAKYLRQKTYIQDIYMKEVRGYLVEGSPDDYTDIKFSVKCAGMTDKIKKEVTFENFKVGFSRKMKPKPVQVPGGVVLVDDTFTIKGHHHHHHHHHH

SEQ ID NO: 170 - protein, 586 aa, Artificial
  mutant recombinant phi29-type DNA polymerase
MKHMPRKMYSCDFETTTKVEDCRVWAYGYMNIEDHSEYKIGNSLDEFMAWVLKVQADLYFHNLKFDGAFIINWLERNGFKWSADGLPNTYNTIISRMGQWYMIDICLGYKGKRKIHTVIYDSLKKLPFPVKKIAKDFKLTVLKGDIDIHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDINSAYPAQMYSRLLPYGEPIVFEGKYVWDEDYPLHIQHIRCEFELKEGYIPTIQIKRSRFYKGNEYLKSSGGEIADLWLSNVDLELMKEHYDLYNVEYISGLKFKATTGLFKDFIDKWTYIKTTSYGAIKQLAKLMLNSLYGKFASNPDVTGKVPYLKENGALGFRLGEEETKDPVYTPMGVFITAWARYTTITAAQACYDRIIYCDTDSIHLTGTEIPDVIKDIVDPKKLGYWEHESTFKRAKYLRQKTYIQDIYMKEVHGYLVEGSPDDYTDIKFSVKCAGMTDKIKKEVTFENFKVGFSRKMKPKPVQVPGGVVLVDDTFTIKGHHHHHHHHHH

SEQ ID NO: 171 - protein, 586 aa, Artificial
  mutant recombinant phi29-type DNA polymerase
MKHMPRKMYSCDFETTTKVEDCRVWAYGYMNIEDHSEYKIGNSLDEFMAWVLKVQADLYFHNLKFDGAFIINWLERNGFKWSADGLPNTYNTIISRMGQWYMIDICLGYKGKRKIHTVIYDSLKKLPFPVKKIAKDFKLTVLKGDIDIHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDINSAYPAQMYSRLLPYGEPIVFEGKYVWDEDYPLHIQHIRCEFELKEGYIPTIQIKRSRFYKGNEYLKSSGGEIADLWLSNVDLELMKEHYDLYNVEYISGLKFKATTGLFKDFIDKWTYIKTTSYGAIKQLAKLMLNSLYGKFASNPDVTGKVPYLKENGALGFRLGEEETKDPVYTPMGVFITAWARYTTITAAQACYDRIIYCDTDSIHLTGTEIPDVIKDIVDPKKLGYWEHESTFKRAKYLRQKTYIQDIYMKKVKGYLVEGSPDDYTDIKFSVKCAGMTDKIKKEVTFENFKVGFSRKMKPKPVQVPGGVVLVDDTFTIKGHHHHHHHHHH

SEQ ID NO: 172 - protein, 575 aa, Artificial; identical to SEQ ID NO: 117
  mutant recombinant phi29-type DNA polymerase

SEQ ID NO: 173 - protein, 575 aa, Artificial
  mutant recombinant phi29-type DNA polymerase
MKHMPRKMYSCDFETTTKVEDCRVWAYGYMNIEDHSEYKIGNSLDEFMAWVLKVQADLYFHNLKFDGAFIINWLERNGFKWSADGLPNTYNTIISRMGQWYMIDICLGYKGKRKIHTVIYDSLKKLPFPVKKIAKDFKLTVLKGDIDYHKERPVGYKITPEEYAYIKNDIQIIAEALLIQFKQGLDRMTAGSDSLKGFKDIITTKKFKKVFPTLSLGLDKEVRYAYRGGFTWLNDRFKEKEIGEGMVFDVNSAYPAQMYSRLLPYGEPIVFEGKYVWDEDYPLHIQHIRCEFELKEGYIPTIQIKRSRFYKGNEYLKSSGGEIADLWLSNVDLELMKEHYDLYNVEYISGLKFKATTGLFKDFIDKWTYIKTTSYGAIKQLAKLMLNSLYGKFASNPDVTGKVPYLKENGALGFRLGEEETKDPVYTPMGVFITAWARYTTITAAQACYDRIIYCDTDSIHLTGTEIPDVIKDIVDPKKLGYWEHESTFKRAKYLRQKTYIQDIYMKEVKGYLVEGSPDDYTDIKFSVKCAGMTDKIKKEVTFENFKVGFSRKMKPKPVQVPGGVVLVDDTFTIK

SEQ ID NO: 174 - protein, 575 aa, Artificial
  mutant recombinant phi29-type DNA polymerase
MKHMPRKMYSCDFETTTKVEDCRVWAYGYMNIEDHSEYKIGNSLDEFMAWVLKVQADLYFHNLKFDGAFIINWLERNGFKWSADGLPNTYNTIISRMGQWYMIDICLGYKGKRKIHTVIYDSLKKLPFPVKKIAKDFKLTVLKGDIDIHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDINSAYPAQMYSRLLPYGEPIVFEGKYVWDEDYPLHIQHIRCEFELKEGYIPTIQIKRSRFYKGNEYLKSSGGEIADLWLSNVDLELMKEHYDLYNVEYISGLKFKATTGLFKDFIDKWTYIKTTSYGAIKQLAKLMLNSLYGKFASNPDVTGKVPYLKENGALGFRLGEEETKDPVYTPMGVFITAWARYTTITAAQACYDRIIYCDTDSIHLTGTEIPDVIKDIVDPKKLGYWEHESTFKRAKYLRQKTYIQDIYMKEVKGYLVEGSPDDYTDIKFSVKCAGMTDKIKKEVTFENFKVGFSRKMKPKPVQVPGGVVLVDDTFTIK

SEQ ID NO: 175 - protein, 575 aa, Artificial
  mutant recombinant phi29-type DNA polymerase
MKHMPRKMYSCDFETTTKVEDCRVWAYGYMNIEDHSEYKIGNSLDEFMAWVLKVQADLYFHNLKFDGAFIINWLERNGFKWSADGLPNTYNTIISRMGQWYMIDICLGYKGKRKIHTVIYDSLKKLPFPVKKIAKDFKLTVLKGDIDIHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDINSAYPAQMYSRLLPYGEPIVFEGKYVWDEDYPLHIQHIRCEFELKEGYIPTIQIKRSRFYKGNEYLKSSGGEIADLWLSNVDLELMKEHYDLYNVEYISGLKFKATTGLFKDFIDKWTYIKTTSYGAIKQLAKLMLNSLYGKFASNPDVTGKVPYLKENGALGFRLGEEETKDPVYTPMGVFITAWARYTTITAAQACYDRIIYCDTDSIHLTGTEIPDVIKDIVDPKKLGYWEHESTFKRAKYLRQKTYIQDIYMKEVKGYLVQGSPDDYTDIKFSVKCAGMTDKIKKEVTFENFKVGFSRKMKPKPVQVPGGVVLVDDTFTIK

SEQ ID NO: 176 - protein, 575 aa, Artificial
  mutant recombinant phi29-type DNA polymerase
MKHMPRKMYSCDFETTTKVEDCRVWAYGYMNIEDHSEYKIGNSLDEFMAWVLKVQADLYFHNLKFDGAFIINWLERNGFKWSADGLPNTYNTIISRMGQWYMIDICLGYKGKRKIHTVIYDSLKKLPFPVKKIAKDFKLTVLKGDIDYHKERPVGYKITPEEYAYIKNDIQIIAEALLIQFKQGLDRMTAGSDSLKGFKDIITTKKFKKVFPTLSLGLDKEVRYAYRGGFTWLNDRFKGKEIGEGMVFDVNSAYPAQMYSRLLPYGEPIVFEGKYVWDEDYPLHIQHIRCEFELKEGYIPTIQIKRSRFYKGNEYLKSSGGEIADLWLSNVDLELMKEHYDLYNVEYISGLKFKATTGLFKDFIDKWTYIKTTSYGAIKQLAKLMLNSLYGKFASNPDVTGKVPYLKENGALGFRLGEEETKDPVYTPMGVFITAWARYTTITAAQACYDRIIYCDTDSIHLTGTEIPDVIKDIVDPKKLGYWEHESTFKRAKYLRQKTYIQDIYMKEVKGYLVEGSPDDYTDIKFSVKCAGMTDKIKKEVTFENFKVGFSRKMKPKPVQVPGGVVLVDDTFTIK

SEQ ID NO: 177 - protein, 575 aa, Artificial
  mutant recombinant phi29-type DNA polymerase
MKHMPRKMYSCDFETTTKVEDCRVWAYGYMNIEDHSEYKIGNSLDEFMAWVLKVQADLYFHNLKFDGAFIINWLERNGFKWSADGLPNTYNTIISRMGQWYMIDICLGYKGKRKIHTVIYDSLKKLPFPVKKIAKDFKLTVLKGDIDYHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDVNSAYPAQMYSRLLPYGEPIVFEGKYVWDEDYPLHIQHIRCEFELKEGYIPTIQIKRSRFYKGNEYLKSSGGEIADLWLSNVDLELMKEHYDLYNVEYISGLKFKATTGLFKDFIDKWTYIKTTSYGAIKQLAKLMLNSLYGKFASNPDVTGKVPYLKENGALGFRLGEEETKDPVYTPMGVFITAWARYTTITAAQACYDRIIYCDTDSIHLTGTEIPDVIKDIVDPKKLGYWEHESTFKRAKYLRQKTYIQDIYMKEVKGYLVEGSPDDYTDIKFSVKCAGMTDKIKKEVTFENFKVGFSRKMKPKPVQVPGGVVLVDDTFTIK

SEQ ID NO: 178 - protein, 575 aa, Artificial
  mutant recombinant phi29-type DNA polymerase
MKHMPRKMYSCDFETTTKVEDCRVWAYGYMNIEDHSEYKIGNSLDEFMAWVLKVQADLYFHNLKFDGAFIINWLERNGFKWSADGLPNTYNTIISRMGQWYMIDICLGYKGKRKIHTVIYDSLKKLPFPVKKIAKDFKLTVLKGDIDIHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDVNSCYPAQMYSRLLPYGEPIVFEGKYVWDEDYPLHIQHIRCEFELKEGYIPTIQIKRSRFYKGNEYLKSSGGEIADLWLSNVDLELMKEHYDLYNVEYISGLKFKATTGLFKDFIDKWTYIKTTSYGAIKQLAKLMLNSLYGKFASNPDVTGKVPYLKENGALGFRLGEEETKDPVYTPMGVFITAWARYTTITAAQACYDRIIYCDTDSIHLTGTEIPDVIKDIVDPKKLGYWEHESTFKRAKYLRQKTYIQDIYMKEVKGYLVEGSPDDYTDIKFSVKCAGMTDKIKKEVTFENFKVGFSRKMKPKPVQVPGGVVLVDDTFTIK

SEQ ID NO: 179 - protein, 575 aa, Artificial
  mutant recombinant phi29-type DNA polymerase
MKHMPRKMYSCDFETTTKVEDCRVWAYGYMNIEDHSEYKIGNSLDEFMAWVLKVQADLYFHDLKFDGAFIINWLERNGFKWSADGLPNTYNTIISRMGQWYMIDICLGYKGKRKIHTVIYDSLKKLPFPVKKIAKDFKLTVLKGDIDYHKERPVGYKITPEEYAYIKNDIQIIAEALLIQFKQGLDRMTAGSDSLKGFKDIITTKKFKKVFPTLSLGLDKEVRYAYRGGFTWLNDRFKEKEIGEGMVFDINSAYPAQMYSRLLPYGEPIVFEGKYVWDEDYPLHIQHIRCEFELKEGYIPTIQIKRSRFYKGNEYLKSSGGEIADLWLSNVDLELMKEHYDLYNVEYISGLKFKATTGLFKDFIDKWTYIKTTSYGAIKQLAKLMLNSLYGKFASNPDVTGKVPYLKENGALGFRLGEEETKDPVYTPMGVFITAWARYTTITAAQACYDRIIYCDTDSIHLTGTEIPDVIKDIVDPKKLGYWEHESTFKRAKYLRQKTYIQDIYMKEVDGYLVEGSPDDYTDIKFSVKCAGMTDKIKKEVTFENFKVGFSRKMKPKPVQVPGGVVLVDDTFTIK

SEQ ID NO: 180 - protein, 575 aa, Artificial
  mutant recombinant phi29-type DNA polymerase
MKHMPRKMYSCDFETTTKVEDCRVWAYGYMNIEDHSEYKIGNSLDEFMAWVLKVQADLYFHNLKFDGAFIINWLERNGFKWSADGLPNTYNTIISRMGQWYMIDICLGYKGKRKIHTVIYDSLKKLPFPVKKIAKDFKLTVLKGDIDYHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDVNSAYPAQMYSRLLPYGEPIVFEGKYVWDEDYPLHIQHIRCEFELKEGYIPTIQIKRSRFYKGNEYLKSSGGEIADLWLSNVDLELMKEHYDLYNVEYISGLKFKATTGLFKDFIDKWTYIKTTSYGAIKQLAKLMLNSLYGKFASNPDVTGKVPYLKENGALGFRLGEEETKDPVYTPMGVFITAWARYTTITAAQACYDRIIYCDTDSIHLTGTEIPDVIKDIVDPKKLGYWEHESTFKRAKYLRQKTYIQDIYMKEVDGYLVEGSPDDYTDIKLSVKCAGMTDKIKKEVTFENFKVGFSRKMKPKPVQVPGGVVLVDDTFTIK

SEQ ID NO: 181 - protein, 575 aa, Artificial
  mutant recombinant phi29-type DNA polymerase
MKHMPRKMYSCDFETTTKVEDCRVWAYGYMNIEDHSEYKIGNSLDEFMAWVLKVQADLYFHNLKFDGAFIINWLERNGFKWSADGLPNTYNTIISRMGQWYMIDICLGYKGKRKIHTVIYDSLKKLPFPVKKIAKDFKLTVLKGDIDYHKERPVGYKITPEEYAYIKNDIQIIAEALLIQFKQGLDRMTAGSDSLKGFKDIITTKKFKKVFPTLSLGLDKEVRYAYRGGFTWLNDRFKEKEIGEGMVFDVNSAYPAQMYSRLLPYGEPIVFEGKYVWDEDYPLHIQHIRCEFELKEGYIPTIQIKRSRFYKGNEYLKSSGGEIADLWLSNVDLELMKEHYDLYNVEYISGLKFKATTGLFKDFIDKWTYIKTTSYGAIKQLAKLMLNSLYGKFASNPDVTGKVPYLKENGALGFRLGEEETKDPVYTPMGVFITAWARYTTITAAQACYDRIIYCDTDSIHLTGTEIPDVIKDIVDPKKLGYWEHESTFKRAKYLRQKTYIQDIYMKEVDGYLVKGSPDDYTDIKFSVKCAGMTDKIKKEVTFENFKVGFSRKMKPKPVQVPGGVVLVDDTFTIK

SEQ ID NO: 182 - protein, 575 aa, Artificial
  mutant recombinant phi29-type DNA polymerase
MKHMPRKMYSCDFETTTKVEDCRVWAYGYMNIEDHSEYKIGNSLDEFMAWVLKVQADLYFHNLKFDGAFIINWLERNGFKWSADGLPNTYNTIISRMGQWYMIDICLGYKGKRKIHTVIYDSLKKLPFPVKKIAKDFKLTVLKGDIDYHKERPVGYKITPEEYAYIKNDIQIIAEALLIQFKQGLDRMTAGSDSLKGFKDIITTKKFKKVFPTLSLGLDKEVRYAYRGGFTWLNDRFKGKEIGEGMVFDVNSAYPAQMYSRLLPYGEPIVFEGKYVWDEDYPLHIQHIRCEFELKEGYIPTIQIKRSRFYKGNEYLKSSGGEIADLWLSNVDLELMKEHYDLYNVEYISGLKFKATTGLFKDFIDKWTYIKTTSYGAIKQLAKLMLNSLYGKFASNPDVTGKVPYLKENGALGFRLGEEETKDPVYTPMGVFITAWARYTTITAAQACYDRIIYCDTDSIHLTGTEIPDVIKDIVDPKKLGYWEHESTFKRAKYLRQKTYIQDIYMKRVDGYLVEGSPDDYTDIKFSVKCAGMTDKIKKEVTFENFKVGFSRKMKPKPVQVPGGVVLVDDTFTIK

SEQ ID NO: 183 - protein, 575 aa, Artificial
  mutant recombinant phi29-type DNA polymerase
MKHMPRKMYSCDFETTTKVEDCRVWAYGYMNIEDHSEYKIGNSLDEFMAWVLKVQADLYFHNLKFDGAFIINWLERNGFKWSADGLPNTYNTIISRMGQWYMIDICLGYKGKRKIHTVIYDSLKKLPFPVKKIAKDFKLTVLKGDIDIHKERPVGYKITPEEYAYIKNDIQIIAEALLIQFKQGLDRMTAGSDSLKGFKDIITTKKFKKVFPTLSLGLDKEVRYAYRGGFTWLNDRFKEKEIGEGMVFDVNSAYPAQMYSRLLPYGEPIVFEGKYVWDEDYPLHIQHIRCEFELKEGYIPTIQIKRSRFYKGNEYLKSSGGEIADLWLSNVDLELMKEHYDLYNVEYISGLKFKATTGLFKDFIDKWTYIKTTSYGAIKQLAKLMLNSLYGKFASNPDVTGKVPYLKENGALGFRLGEEETKDPVYTPMGVFITAWARYTTITAAQACYDRIIYCDTDSIHLTGTEIPDVIKDIVDPKKLGYWEHESTFKRAKYLRQKTYIQDIYMKEVDGYLVEGSPDDYTDIKFSVKCAGMTDKIKKEVTFENFKVGFSRKMKPKPVQVPGGVVLVDDTFTIK

SEQ ID NO: 184 - protein, 575 aa, Artificial
  mutant recombinant phi29-type DNA polymerase
MKHMPRKMYSCDFETTTKVEDCRVWAYGYMNIEDHSEYKIGNSLDEFMAWVLKVQADLYFHNLKFRGAFIINWLERNGFKWSADGLPNTYNTIISRMGQWYMIDICLGYKGKRKIHTVIYDSLKKLPFPVKKIAKDFKLTVLKGDIDIHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDINSAYPAQMYSRLLPYGEPIVFEGKYVWDEDYPLHIQHIRCEFELKEGYIPTIQIKRSRFYKGNEYLKSSGGEIADLWLSNVDLELMKEHYDLYNVEYISGLKFKATTGLFKDFIDKWTYIKTTSYGAIKQLAKLMLNSLYGKFASNPDVTGKVPYLKENGALGFRLGEEETKDPVYTPMGVFITAWARYTTITAAQACYDRIIYCDTDSIHLTGTEIPDVIKDIVDPKKLGYWEHESTFKRAKYLRQKTYIQDIYMKEVKGYLVEGSPDDYTDIKFSVKCAGMTDKIKKEVTFENFKVGFSRKMKPKPVQVPGGVVLVDDTFTIK

SEQ ID NO: 185 - protein, 575 aa, Artificial
  mutant recombinant phi29-type DNA polymerase
MKHMPRKMYSCDFETTTKVEDCRVWAYGYMNIEDHSEYKIGNSLDEFMAWVLKVQADLYFHDLKFDGAFIINWLERNGFKWSADGLPNTYNTIISRMGQWYMIDICLGYKGKRKIHTVIYDSLKKLPFPVKKIAKDFKLTVLKGDIDIHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDINSAYPAQMYSRLLPYGEPIVFEGKYVWDEDYPLHIQHIRCEFELKEGYIPTIQIKRSRFYKGNEYLKSSGGEIADLWLSNVDLELMKEHYDLYNVEYISGLKFKATTGLFKDFIDKWTYIKTTSYGAIKQLAKLMLNSLYGKFASNPDVTGKVPYLKENGALGFRLGEEETKDPVYTPMGVFITAWARYTTITAAQACYDRIIYCDTDSIHLTGTEIPDVIKDIVDPKKLGYWEHESTFKRAKYLRQKTYIQDIYMKEVKGYLVEGSPDDYTDIKFSVKCAGMTDKIKKEVTFENFKVGFSRKMKPKPVQVPGGVVLVDDTFTIK

SEQ ID NO: 186 - protein, 575 aa, Artificial
  mutant recombinant phi29-type DNA polymerase
MKHMPRKMYSCDFETTTKVEDCRVWAYGYMNIEDHSEYKIGNSLDEFMAWVLKVQADLYFHNLKFDGAFIINWLERNGFKWSADGLPNTYNTIISRMGQWYMIDICLGYKGKRKIHTVIYDSLKKLPFPVKKIAKDFKLTVLRGDIDIHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDINSAYPAQMYSRLLPYGEPIVFEGKYVWDEDYPLHIQHIRCEFELKEGYIPTIQIKRSRFYKGNEYLKSSGGEIADLWLSNVDLELMKEHYDLYNVEYISGLKFKATTGLFKDFIDKWTYIKTTSYGAIKQLAKLMLNSLYGKFASNPDVTGKVPYLKENGALGFRLGEEETKDPVYTPMGVFITAWARYTTITAAQACYDRIIYCDTDSIHLTGTEIPDVIKDIVDPKKLGYWEHESTFKRAKYLRQKTYIQDIYMKEVKGYLVEGSPDDYTDIKFSVKCAGMTDKIKKEVTFENFKVGFSRKMKPKPVQVPGGVVLVDDTFTIK

SEQ ID NO: 187 - protein, 575 aa, Artificial
  mutant recombinant phi29-type DNA polymerase
MKHMPRKMYSCNFETTTKVEDCRVWAYGYMNIEDHSEYKIGNSLDEFMAWVLKVQADLYFHNLKFDGAFIINWLERNGFKWSADGLPNTYNTIISRMGQWYMIDICLGYKGKRKIHTVIYDSLKKLPFPVKKIAKDFKLTVLKGDIDYHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDVNSAYPAQMYSRLLPYGEPIVFEGKYVWDEDYPLHIQHIRCEFELKEGYIPTIQIKRSRFYKGNEYLKSSGGEIADLWLSNVDLELMKEHYDLYNVEYISGLKFKATTGLFKDFIDKWTYIKTTSYGAIKQLAKLMLNSLYGKFASNPDVTGKVPYLKENGALGFRLGEEETKDPVYTPMGVFITAWARYTTITAAQACYDRIIYCDTDSIHLTGTEIPDVIKDIVDPKKLGYWEHESTFKRAKYLRQKTYIQDIYMKEVDGYLVEGSPDDYTDIKFSVKCAGMTDKIKKEVTFENFKVGFSRKMKPKPVQVPGGVVLVDDTFTIK

SEQ ID NO: 188 - protein, 575 aa, Artificial
  mutant recombinant phi29-type DNA polymerase
MKHMPRKMYSCDFETTTKVEDCRVWAYGYMNIEDHSEYKIGNSLDEFMAWVLKVQADLYFHNLKFDGAFIINWLERNGFKWSADGLPNTYNTIISRMGQWYMIDICLGYKGKRKIHTVIYDSLKKLPFPVKKIAKDFKLTVLKGDIDFHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDINSAYPAQMYSRLLPYGEPIVFEGKYVWDEDYPLHIQHIRCEFELKEGYIPTIQIKRSRFYKGNEYLKSSGGEIADLWLSNVDLELMKEHYDLYNVEYISGLKFKATTGLFKDFIDKWTYIKTTSYGAIKQLAKLMLNSLYGKFASNPDVTGKVPYLKENGALGFRLGEEETKDPVYTPMGVFITAWARYTTITAAQACYDRIIYCDTDSIHLTGTEIPDVIKDIVDPKKLGYWEHESTFKRAKYLRQKTYIQDIYMKEVKGYLVEGSPDDYTDIKFSVKCAGMTDKIKKEVTFENFKVGFSRKMKPKPVQVPGGVVLVDDTFTIK

SEQ ID NO: 189 - protein, 575 aa, Artificial
  mutant recombinant phi29-type DNA polymerase
MKHMPRKMYSCDFETTTKVEDCRVWAYGYMNIEDHSEYKIGNSLDEFMAWVLKVQADLYFHNLKFDGAFIINWLERNGFKWSADGLPNTYNTIISRMGQWYMIDICLGYKGKRKIHTVIYDSLKKLPFPVKKIAKDFKLTVLKGDIDIHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDINSAYPAQMYSRLLPYGEPIVFEGKYVWDEDYPLHIQHIRCEFELKEGYIPTIQIKRSRFYKGNEYLKSSGGEIADLWLSNVDLELMKEHYDLYNVEYISGLKFKATTGLFKDFIDKWTYIKTTSYGAIKQLAKLMLNSLYGKFASNPDVTGKVPYLKENGALGFRLGEEETKDPVYTPMGVFITAWARYTTITAAQACYDRIIYCDTDSIHLTGTEIPDVIKDIVDPKKLGYWEHESTFKRAKYLRQKTYIQDIYMKEVRGYLVEGSPDDYTDIKFSVKCAGMTDKIKKEVTFENFKVGFSRKMKPKPVQVPGGVVLVDDTFTIK

SEQ ID NO: 190 - protein, 575 aa, Artificial
  mutant recombinant phi29-type DNA polymerase
MKHMPRKMYSCDFETTTKVEDCRVWAYGYMNIEDHSEYKIGNSLDEFMAWVLKVQADLYFHNLKFDGAFIINWLERNGFKWSADGLPNTYNTIISRMGQWYMIDICLGYKGKRKIHTVIYDSLKKLPFPVKKIAKDFKLTVLKGDIDIHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDINSAYPAQMYSRLLPYGEPIVFEGKYVWDEDYPLHIQHIRCEFELKEGYIPTIQIKRSRFYKGNEYLKSSGGEIADLWLSNVDLELMKEHYDLYNVEYISGLKFKATTGLFKDFIDKWTYIKTTSYGAIKQLAKLMLNSLYGKFASNPDVTGKVPYLKENGALGFRLGEEETKDPVYTPMGVFITAWARYTTITAAQACYDRIIYCDTDSIHLTGTEIPDVIKDIVDPKKLGYWEHESTFKRAKYLRQKTYIQDIYMKEVHGYLVEGSPDDYTDIKFSVKCAGMTDKIKKEVTFENFKVGFSRKMKPKPVQVPGGVVLVDDTFTIK

SEQ ID NO: 191 - protein, 575 aa, Artificial
  mutant recombinant phi29-type DNA polymerase
MKHMPRKMYSCDFETTTKVEDCRVWAYGYMNIEDHSEYKIGNSLDEFMAWVLKVQADLYFHNLKFDGAFIINWLERNGFKWSADGLPNTYNTIISRMGQWYMIDICLGYKGKRKIHTVIYDSLKKLPFPVKKIAKDFKLTVLKGDIDIHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDINSAYPAQMYSRLLPYGEPIVFEGKYVWDEDYPLHIQHIRCEFELKEGYIPTIQIKRSRFYKGNEYLKSSGGEIADLWLSNVDLELMKEHYDLYNVEYISGLKFKATTGLFKDFIDKWTYIKTTSYGAIKQLAKLMLNSLYGKFASNPDVTGKVPYLKENGALGFRLGEEETKDPVYTPMGVFITAWARYTTITAAQACYDRIIYCDTDSIHLTGTEIPDVIKDIVDPKKLGYWEHESTFKRAKYLRQKTYIQDIYMKKVKGYLVEGSPDDYTDIKFSVKCAGMTDKIKKEVTFENFKVGFSRKMKPKPVQVPGGVVLVDDTFTIK

SEQ ID NO: 192 - protein, 613 aa, Artificial
  mutant recombinant phi29-type DNA polymerase
MKHMPRKMYSCDFETTTKVEDCRVWAYGYMNIEDHSEYKIGNSLDEFMAWVLKVQADLYFHNLKFDGAFIINWLERNGFKWSADGLPNTYNTIISRMGQWYMIDICLGYKGKRKIHTVIYDSLKKLPFPVKKIAKDFKLTVLKGDIDYHKERPVGYKITPEEYAYIKNDIQIIAEALLIQFKQGLDRMTAGSDSLKGFKDIITTKKFKKVFPTLSLGLDKEVRYAYRGGFTWLNDRFKEKEIGEGMVFDVNSAYPAQMYSRLLPYGEPIVFEGKYVWDEDYPLHIQHIRCEFELKEGYIPTIQIKRSRFYKGNEYLKSSGGEIADLWLSNVDLELMKEHYDLYNVEYISGLKFKATTGLFKDFIDKWTYIKTTSYGAIKQLAKLMLNSLYGKFASNPDVTGKVPYLKENGALGFRLGEEETKDPVYTPMGVFITAWARYTTITAAQACYDRIIYCDTDSIHLTGTEIPDVIKDIVDPKKLGYWEHESTFKRAKYLRQKTYIQDIYMKEVDGYLVEGSPDDYTDIKFSVKCAGMTDKIKKEVTFENFKVGFSRKMKPKPVQVPGGVVLVDDTFTIKGHHHHHHHHHHGGGSGGGSGGGSGLNDFFEAQKIEWHE

SEQ ID NO: 193 - protein, 613 aa, Artificial
  mutant recombinant phi29-type DNA polymerase
MKHMPRKMYSCDFETTTKVEDCRVWAYGYMNIEDHSEYKIGNSLDEFMAWVLKVQADLYFHNLKFDGAFIINWLERNGFKWSADGLPNTYNTIISRMGQWYMIDICLGYKGKRKIHTVIYDSLKKLPFPVKKIAKDFKLTVLKGDIDIHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDINSAYPAQMYSRLLPYGEPIVFEGKYVWDEDYPLHIQHIRCEFELKEGYIPTIQIKRSRFYKGNEYLKSSGGEIADLWLSNVDLELMKEHYDLYNVEYISGLKFKATTGLFKDFIDKWTYIKTTSYGAIKQLAKLMLNSLYGKFASNPDVTGKVPYLKENGALGFRLGEEETKDPVYTPMGVFITAWARYTTITAAQACYDRIIYCDTDSIHLTGTEIPDVIKDIVDPKKLGYWEHESTFKRAKYLRQKTYIQDIYMKEVKGYLVEGSPDDYTDIKFSVKCAGMTDKIKKEVTFENFKVGFSRKMKPKPVQVPGGVVLVDDTFTIKGHHHHHHHHHHGGGSGGGSGGGSGLNDFFEAQKIEWHE

SEQ ID NO: 194 - DNA, 76 bp, Artificial
  synthetic oligonucleotide primer
acgacgttgacaataatacaagtccgatacatgataattaccgataagttcgtcgagagcacattaggctggctgg

SEQ ID NO: 195 - DNA, 55 bp, Artificial
  synthetic oligonucleotide primer
ccagccagcctaatgtgctctcgacgaacttatcggtaattatcatgtatcggac

SEQ ID NO: 196 - DNA, 34 bp, Artificial
  synthetic oligonucleotide
ggtgatgtagataggtggtaggtggtgtcagatc

SEQ ID NO: 197 - DNA, 54 bp, Artificial
  synthetic oligonucleotide
  misc_feature (25)..(25): n is iAmMC6T, an Int amino modified C6 dT labeled with alexa fluor 488
acgacgttgacaataatacggatcngacaccacctaccacctatctacatcacc

SEQ ID NO: 198 - DNA, 50 bp, Artificial
  synthetic oligonucleotide
tctgaggcaacagataggtctatgtagcttaagagagtaattactctctt

SEQ ID NO: 199 - DNA, 22 bp, Artificial
  synthetic oligonucleotide
gcgacctatctgttgcctcaga

SEQ ID NO: 200 - DNA, 80 bp, Artificial
  extension product of synthetic oligonucleotide
tctgaggcaacagataggtctatgtagcttaagagagtaattactctcttaagctacatagacctatcagttgcctcaga

What is claimed is:

1. A composition comprising a recombinant DNA polymerase, which recombinant DNA polymerase comprises an amino acid sequence that is at least 90% identical to SEQ ID NO:1 or SEQ ID NO:2; which recombinant polymerase comprises a mutation at position V250 and a mutation at position L253, wherein identification of positions is relative to wild-type Φ29 polymerase (SEQ ID NO:1); and which recombinant DNA polymerase exhibits polymerase activity.

2. The composition of claim 1, wherein the mutation at position V250 comprises a V250I substitution and the mutation at position L253 comprises an L253A substitution.

3. The composition of claim 1, wherein the composition comprises $Mg^{++}$, wherein the composition is present in a DNA sequencing system that comprises a zero-mode waveguide, and wherein the recombinant polymerase is immobilized on a surface of the zero-mode waveguide in an active form.

4. The composition of claim 1, wherein the mutation at position V250 comprises a V250I substitution.

5. The composition of claim 1, wherein the recombinant polymerase comprises a combination of mutations selected from the group consisting of:
a) V250I, L253A, E375Y, and K512Y; and
b) V250I, L253A, E375Y, A484E, and K512Y.

6. The composition of claim 1, wherein the recombinant polymerase comprises one or more exogenous features at the C-terminal and/or N-terminal region of the polymerase.

7. The composition of claim 1, comprising a phosphate-labeled nucleotide analog and a DNA template, wherein the recombinant polymerase incorporates the nucleotide analog into a copy nucleic acid in response to the DNA template.

8. A method of sequencing a DNA template, the method comprising:
a) providing a reaction mixture comprising:
the DNA template,
a replication initiating moiety that complexes with or is integral to the template,
the recombinant polymerase of claim 1, wherein the polymerase is capable of replicating at least a portion of the template using the moiety in a template-dependent polymerization reaction, and
one or more nucleotides and/or nucleotide analogs;

b) subjecting the reaction mixture to a polymerization reaction in which the modified recombinant polymerase replicates at least a portion of the template in a template-dependent manner, whereby the one or more nucleotides and/or nucleotide analogs are incorporated into the resulting DNA; and c) identifying a time sequence of incorporation of the one or more nucleotides and/or nucleotide analogs into the resulting DNA.

* * * * *